United States Patent 7,745,391 (HUMAN THROMBOSPONDIN POLYPEPTIDE) - sequence listing, part 122

SEQ ID NO: 347501 - DNA, 751 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagcaaatgaaccagtgagtgaagggcattatcacaactccaagaaccaactaggagtcacccatgacatcatctcctgaatttcatcaccaagcccagctgatcctatttcctaaatggttcctgatttctctcttctgttttctgtctctgccaccactgtcctagcacaggcattgcacatctctcatatgaacgcctgcaggactgtcccttgatgttatccttgcagcccctacattcctactgtgcagccagtaaagtcatattaaaatgcttatttgatca

SEQ ID NO: 347502 - DNA, 7276 bp, Homo sapiens
  misc_feature (6809)..(6809): n is a, c, g, or t
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacantaaaaaaaaaaaaaaaaaaaaaaaaaaaaaaaaaaaaaaaaaaaaaaaaaaaaaaaaaaaaaaaggggggggggcaaaaaaaattccccgggggggcccatttcccaccctttttttgtgaaagggggccccagaaggggagggccttatataaacagaagaggaaggcggcggcttttaaacacccgtgtcgtcgctgggaaaacaagtgctctttgcgggtcatcttggtggaagaagaacccctttgtcgtgcggcggcactcgtgtcccgaccaccccccacaaagaaattaaagaccagagaaactaaaccattgggctttaatggtgctaaccccgagcccttcggtgggggaagaatcgtttctgcttcttttttcaattaccctgtcgtttcatcactacagggacagatacaaaaaaacacagagaaacaagacagtagaagaaaaagagcaatcgaa

SEQ ID NO: 347503 - DNA, 6865 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347504 - DNA, 6898 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttatgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347505 - DNA, 6889 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347506 - DNA, 6811 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347507 - DNA, 3753 bp, Homo sapiens
aacttcttaggcaagaaccagagaagtcagtgacatcttaaaagataacttatggagatggggcttcaaaagttatcttttaagatgtcactgacttctctgattctttttctcaaagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaaaacatgcc

SEQ ID NO: 347508 - DNA, 4271 bp, Homo sapiens
attataacagccaatgcagccgccatccacgcacaagcaaagaagcatgtcccatttaaatacacccacgcagccccagcgcccttagccgatcggggcgctcagcaacagcgcaccgctgctcggggcttggagatccgcgcaggctgggctcccggacccggcggaccgacgcgcggaggatcgggatccggcgctgtggggctggggtgggcgggggaggctgggccggggctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccctgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaatccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgcttccccatgagcctgccaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtgggtaggttaaccattccttatctccttcagcagttacaccccccaaatgaaacgaaaatcaagaaatgtgaaacaaccatttgattccacaaaa

SEQ ID NO: 347509 - DNA, 290 bp, Homo sapiens
gaggaagggagcgggtctccgcaggcggaagtttgctttggaagattttattccagacgctgtcctggtccctggacggttaggaacggttgggtcctgctactgcctccgtggggcagggagcctcgcgagaccagcactgcgccctactcggtccaccctgtccccgctccgcgctaggggctcaccctgggaacaggggtcgggcgatcctggtcattgggggatcttccgcactagcttccatcacaatacctggcaggtgatgagcaataaatatttgctgaaag

SEQ ID NO: 347510 - DNA, 824 bp, Homo sapiens
gctgaggtgggagaatcgcttgaacctgggaggcagaggttgcggtgagctgcgattgtgccgtgattgtgccattgctcttcagcctgggcaacaacagcaaaattccatctcaaaaaaagaaaaaaaagaaatgcaggatgatcagagaacatatgacaggtgaatctgagctagtcttgcaagtaggggatagagagatgtgagataattaatggctcctggagaatgtaggggttggaaggaggaatgggggaaagaaaggaatattcttgagggccagagctatggatttgaaggcccagagacccttgaccaacattgtatcagtcagagtctattctcggtttctatgaagtcctatgctgctttacctaacatttgcatagtattccaaaagaaatgctttaaaaatgttttttgtaaaaccctgtgaggttaaaagaaggcttattttgcatgttgaagtctctttcagaaactattttctgtgtgagtacaacttattcatgattgtacctagtaaatggctgagtcagaattggaaactagggttttggaccccaagtccttcgcaggccacccttttagattacctttgggagagcttggcagagttttgcatttcttaacctcctttttcacgatagaatggcagtatggcagatgtgccaaagtgtgagatctggaatcagactgacttgtgtctgaattccagcttctactgtttcctagttggaaaataacatttattatatttctttgaatctaagatgccattaattggaacatataccttcatttcagaaagtataaaatgtaaa

SEQ ID NO: 347511 - DNA, 1008 bp, Homo sapiens
tggtaacatgattaatccactggtatgcaggatagagtgggaggaaacatgggataagaaaacgattatagtattagagatttaaggacctgagtaaggatggtgttagtaagaatagaaaaggagaaagaagaatggcctttcaaagggaaagatccataatgtagcagctattataaatgacatcaccatggttaaatatttgaataaacaatggctatggataatcatgtagaacactggaaatagagaaaatattaatagcaaagaatatttaaggcaaggatagtatgtagagacaaagtgtggaacattttaaggcaggaatagtcaatattgaattccacagagactatggaatctaattttgatttgaggcattggttggtgagtgcacagtttctaaatatacaataatatggtttctctgaattgagcatgatagtaactagattaagatgagtaagatttgaatagagaaagtaaactcaagaaaaagtcaaagaaaaaaatgatggctctgttgattaaatacagggaatgaatgggaggaacatgaaatacgagtactaaaaatgatcttagtggattttttaaaaagtttttttttgtaaactaaaggtatggaaactagtggagtatgtaaatgtgaaaccagtagttattcatttactcaaatatgttgtgtttgctctgtgtaaggcattgtgctaggttctataaaagattcataaagattcattttcaatagcaaaaaaaacagaaccttggaataaacttaacaggaaatgtgtggagtttatgaaaaatactataaaaatgaacagagggatagtaagggagagttgatcagatggaagagcatacattttaagtggatgaagagacattattgagatgccagctttccacaaaataatcgataaccttgggggattgttttatggcttgacataatgatcttaatatttgtctgaaaaattactgggagattggcatagaaaatta

SEQ ID NO: 347512 - DNA, 774 bp, Homo sapiens
agacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggttgtgccacaagaacaccagggcgtgccacaagaaccccagggcctcccagaccagcaggccagtagatctgctctaaagaggttaacagaggaggtagagctacctaccttcccccagggctcaaaacgttgagcgtcttccccaaacctgtagatcatacttgggacagattctgcccacgcagagatcgcggatcgctgttacctccaggtgcagtggctgcggctatccctacaggaaatgcggcctggataacagaggtccccagggtgttcgcggggccctggacacgttccgaggcgcggctcagagtcccatgtccgaggcggtgggaagccccagcgagcggctgcgggcgctgttcaggactcgcgcgaggcgcgtggcggagatggaagcgcagagccgggccctgcagctacgcggcgagggtgaaggagatgggggacggggaccaaggacctcctctg

SEQ ID NO: 347513 - DNA, 718 bp, Homo sapiens
agacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcgaactgagccgacgcctccaagttgtggcctgtacgcggggcgggatgtcccgcctcttcggcctggagcaggagattcgagaactacaagctgaggccgggaggacgcggggagctctagaggtgttgggggcccgcattcaggagctgcaggcggagccagggaacccgctgagctcccggcgagaggcagaactttattctccagtgcaaaaggccaacccgggaactctggctgccgaaatccgggcgctgcgggaggcctacattcgagacgggggccgggaccccggcgtgctgggccagatatggcagttgcaggtggaggcgtctgcactggagctgcagcggtcgcagacccgcagaggaagggcaggtgccacctcaggggagcttccagtagtggaggctgaaaacc

SEQ ID NO: 347514 - DNA, 466 bp, Homo sapiens
tttgccaggtagttctctggattggagaatggtacaaactgttacatccacttgggagtacagcaatgaaaaagatgacacttgccttttagaggctattaaatgaccaatgatgtagtaagtgataagggcccagcctagtctaggaggcagctgctttttcctctttattaatagtcagggaaaccaagctacaattagagacttgcccacgttcagactttgtaacactttttcaagccagtggctcctcccaaacggccgaggtttccccacccattctcctgacctgcccagccctgtggttgctgtccagggagctaaggctctccccaaacaaacttgaagatctcacagacctaatagacacggcctttcctctctgcctctggctttatgtctctttcatcctcctctgcctttcccctgcccttgatcccttctgcaggtcttggctggtttcagg

SEQ ID NO: 347515 - DNA, 782 bp, Homo sapiens
agacctaatagacacggcctttcctctctgcctctggctttatgtctctttcatcctcctctgcctttcccctgcccttgatcccttctgcaggtcttggctggtttcaggaaacgggtcccatcccatggactcccactctggggagcctgcgctcctgccctgtgggacctgtgacatggttttccgctcctcagctctgttagccacccatactcagcgcttctgcattggccacccgacccaagagatgacatttggagcacaggcatcagttgccactgaaccccagcgggccgcggtaagggcctccatggccatgggtggggattcaaaggagccaggacctttatgattcctcatcctactacaccctatccccaggttgtgccacaagaacaccagggcgtgccacaagaaccccagggcctcccagaccagcaggccagtagatctgctctaaagaggttaacagaggaggtagagctacctaccttcccccagggctcaaaacgttgagcgtcttccccaaacctgtagatcatacttgggacagattctgcccacgcagagatcgcggatcgctgttacctccaggtgcagtggctgcggctatccctacaggaaatgcggcctggataacagaggtccccagggtgttcgcggggccctggacacgttccgaggcgcggctcagagtcccatgtccgaggcggtgggaagccccagcgagcggctgcgggcgctgttcaggactcgcgcgaggcgcgtggcggagatgg

SEQ ID NO: 347516 - DNA, 387 bp, Homo sapiens
aattccagctccttacccagctcagccctgagtccgttacatcttgacatcagcttctcatgcagttgtttgctctgatttaaataaagtcacatcagtgggggtatttccttaccgacaccccgtcttacgtccgaaagatgtcagtaaacttacctatattccatacaaggctaagctaatccataagtgcgtttgtttaggtgaaggaaaggaggaggtaggaagctgggccggagcgcagcagccatggtgcgtgtcgaaaggacccccagccctgcggaaggtgggcctgggtgtgattctgagattgctggattctcaaggagtggagcgcagcagggcagactggaaacataaaaacaaaacaagcaaaataaataaata

SEQ ID NO: 347517 - DNA, 589 bp, Homo sapiens
gactgagctgccaggtggctggggagtgtgtgtgcaactggaacactcctctgacgcatcgtgggttccgttccccgactcacttctcattgcctggaaagcataggaaaatttcagttcctgcccttgataggcagtccagcaaaacttacatatgactttgctgcctgaaattctttctggaacagggcaaggtataaataaataaataacatatcactttttggaatttaaagtgctgtgtcctttgatagcaacagcaaagcaagagaggttgactggacagccactccacacctcgatggccgttcccagttcccctctgttgactgcagacagggtcagtacctccttcatcaggaaaatggagacatccagtgtgagctcctcagagcccctccaccactgcacagtgacatttacctcttagtctcctgtgtcactggatgaggcgtccttgctgctgggcttacccttccacctgtagtcccagctacttggggagctgacaagaatcgcttgaacccgggagttggaggttgcagtgagctgcactccagccaggcgccagagagagattccatcttaa

SEQ ID NO: 347518 - DNA, 701 bp, Homo sapiens
gactgagctgccaggtggctggggagtgtgtgtgcaactggaacactcctctgacgcatcgtgggttccgttccccgactcacttctcattgcctggaaagcataggaaaatttcagttcctgcccttgataggcagtccagcaaaacttacatatgactttgctgcctgaaattctttctggaacagggcaaggtataaataaataaataacatatcactttttggaatttaaagtgctgtgtcctttgatagcaacagcaaagcaagagaggttgactggacagccactccacacctcgatggccgttcccagttcccctctgttgactgcagacagggtcagtacctccttcatcaggaaaatggagacatccagtgtgagctcctcagagcccctccaccactgcacagtgacatttacctcttagtctcctgtgtcactggatgaggcgtccttgctgctgggcttacccttccacctctgcccttgttccctttccttcctgtctcctgtcagactgcctcatcgtttattgcctttcctgttttctgtgattactcctttttataggctcctctctctcagcctgtaaatatatgtgagcccctcacatcctaacatgagtctcccttgatcctatgtcttctaagtgtttgctgatcttcctgaggtttctgttcggcactgttgctgctttc

SEQ ID NO: 347519 - DNA, 452 bp, Homo sapiens
ctaaaggcactattttaatcacaatgaaagccatttttcttttgcgatttggataatatttcaaaactagtctgtatgctgtacattcctttcatcaaaatgtgtgtgattttatacccttgaactctgagctagcccataaagatgaagaaatgagtaagatatgatccatccatgctttttcttgggagagtgaaacaagcaagcctatgattccataatacatttgtaagatattatttttctcaaatgtatttcttttccatgcacatacaaaaaagcagctccttagaatcatgattaagtagttgctttagaaagtgtatgtgtgaggcgggtggatcacgaggtcgggagttcgagaccagcctgacacggtgaaaccctgtctctactaaaaatacaaaaattagctgagcgtggcggtgcgcacctgtaatcccagctactca

SEQ ID NO: 347520 - DNA, 320 bp, Homo sapiens
tggaatctgtgactgcatcagctcagaagcaggcctttgctgctcctggtctcttctgaatctttgggtcagtggttctcaaccctggctgcagagaattagagtcacttgctgggggcggatgggctggggagttatatgccaaaacttgcgcctatttccctaaagttcggatttaattggtctgccctggggcataaacagtattgctatttaaaaatcaggcttcccctggtgactgtaatgtgctaccagggctatgaagcactgatctggggtcttggggaattatggtttgagaagcacaaactcagatatca

SEQ ID NO: 347521 - DNA, 1011 bp, Homo sapiens
tcttgttaaaccaagagcaatgtttcgtttgctcaatatcacatttacaaaggaaactacaaaaaaaaaaggcatcacaaaatcatcttgaacgttcacctcttcccaccaatacatcaactcttaggctttagacagggcctgggaatacttcagcggtcttaaaataggaaaatagacactatggctacaaaaaataaaaaataaatgaggtagataaattaaagctttcacacccaggacgtgcctgttctaacttcgtagccttcatgaaatattcagcaaggaaacaaaacaaaacaaaaaatcgtcataattacttggcataagtcgcaccaaggaaattcaacaaaagcaatcagtatgtgaacctgtgatgggaaacacgcccttccacgagtttcttctcgagcatgaaaacccagttcttcaatagagtaggcactggcaaactaagtcacctgagattccccgctcaggtgcccacctcttctgggatttgggaagaggaaggcatccaagaggtgtggggaaaacattggcactctcggggctccaactgaactgtatttaaataagcagcaacacacacattgactccctaaggactaacgtaagtccatttgagggcctcctacttaaggttctaaggttgaagcagttttataattctacaaccctagttttttgttgttccttttttaagtacattcaaaaaaaaacaataagatggggacagggttggggcatataaaacaggtccctaaagagatgacagaccttgtccttttacccgtgtccagttaccagtaagtatacagtacccatctcccctcaatgaggctgtgtagttgtcttttccactgttgttcagtaagttccaacgattctaccttgaaataggtaacagtctttggaaaaagtcactctaggttgtacaaaggttctatgtatacgtctgttacaagtaacaaagctactttgcaagacccgcttctttccaaaattaga

SEQ ID NO: 347522 - DNA, 2892 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347523 - DNA, 2868 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347524 - DNA, 2398 bp, Homo sapiens
gcctgcatgtgactctgtaggatctccggtccatcacagttagcagatggacgtgtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347525 - DNA, 2161 bp, Homo sapiens
  misc_feature (55)..(55): n is a, c, g, or t
atgctggtgctagggaatcgtgcgggggttcaagcaaaggagatgggctcccagntgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347526 - DNA, 1924 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccacagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatgggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347527 - DNA, 2128 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccacagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatgggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtttgcaattgtgagttcttttgcttcctcctgctgctgctacagagcagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaa

SEQ ID NO: 347528 - DNA, 1292 bp, Homo sapiens
agcggatgcggagcggctaggtggtgcacgggaaacgcgggcgtaggtgaccggcggctttctcagttttggtggagacgggcgcatgcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347529 - DNA, 1423 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagctgcccgcggcgtttccacacaggagatctagctaggtcacccgccagggatctccctactcgctg

SEQ ID NO: 347530 - DNA, 414 bp, Homo sapiens
ctcctgatacatgaagccaccctggaagatggtttggaagaggaagcagtggaaaagacacacaggtagcaaaggccggtcagtccttgtcgcccacatcctctccctcccccactacgtgacactgagcagccgtcgtttgtctccactgatgtggggctgccctgcttcctatcaagggctatgggggcttccttgacctgtggcagtgctcacaggctcttggcctttatttttgcagaattttctaagcaagattctagagtgaggcacagttttttgaaagcatctagaaatcggctgaataaactataagccatgtcagggaattgccaggggaaggcgggggctgggggactgaatttttggctgctaatttcaacgaaagagtgcattaccccaggtgggccctgt

SEQ ID NO: 347531 - DNA, 356 bp, Homo sapiens
tgatgcccagcctttgtgtaagtctacttgaaagggtttcagggttccatggatacttctttgctataaagaggatgacacatgtaaaatcacctttatggttaaattaattggcttttatattagctcctcaaagcaaagcaggagagacagaaatttctgcagttgcttcttggtcctgtccaaagcagacatcagcctctgaaccatcagcagtcttcctagtggcagtgactctcttcctcttctcttctgcagccccgacacgtctctgctactggactgtggtgagggcacatttgggcagctgtgccgtcattacggagaccaggtggacagggtcctgggcaccctgg

SEQ ID NO: 347532 - DNA, 2988 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347533 - DNA, 3066 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagaggtaaggggcacagccgcaggcatcatgggggcgaggtggggagcagagctgcagagccctccagccccaccctttcagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347534 - DNA, 3192 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtttgcaattgtgagttcttttgcttcctcctgctgctgctacagagcagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaa

SEQ ID NO: 347535 - DNA, 3124 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtcagtcaacgagccacgccccgtcccgctgggccctcagtgcggcgcagcctctgagcatcggggcacctcccagggcttcggcttccctgcttcacacatgtggttcactgttgcgggggttcgtggagttatggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347536 - DNA, 2591 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccacagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347537 - DNA, 2123 bp, Homo sapiens
gagatgcttttcccgtccttgacagcagcaatgatgggagcgatggcagctgtcccaactgggagaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347538 - DNA, 2291 bp, Homo sapiens
agactgaagaaaaccttaatgccaagcctcctttcctggccagtgtaggcctgaagtgcctcaacctgacagttacctgtttaggtatccacaaagagaccagaagggtgttgatggtgatgtgtaaagttggttttgtgctttgtttacctctcagctcactggataggatatgtcatgttagcagttgccttgaaggcagttcagtttggtggctgagctgtgacccccagtgggcgggcttatttggttttgcagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttggggtcccacataagcactagtctatagatgcctcttaggactggtgcctggcacagctgcgggccaggaggctgccacacggaagcaagcagatgaactaatttcatttcaaggcagtttttaaagaagtcatggaaacagacggcggcacctttcctctaatccagcaaaatgattccctgcacaccagagacaagcagagtaacaggatcagtgggtctaagtgtccgagacttaacgaaaatagtatttcagctgcaataaagattgagtt

SEQ ID NO: 347539 - DNA, 715 bp, Homo sapiens
agcggatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtcagtcaacgagccacgccccgtcccgctgggccctcagtgcggcgcagcctctgagcatcggggcacctcccagggcttcggcttccctgcttcacacatgtggttcactgttgcgggggttcgtggagttatggtgggtgggaaatccgagattctttgcatccatgtgatttctgcggatctgtgaagaacttcaggcctgggtctgagcgtccttttcccaacccttgggccccggcctggctgtcagcactttcggagctccaccctcttccgtgcaccccaaggccagtgtgtcgttgttagcgtgtggggtggacagatctggtgtgtagccggtggtggagaaaggactcattttgtcctagcacccacacacaca

SEQ ID NO: 347540 - DNA, 912 bp, Homo sapiens
gaaatgtctagtactgaagacatctaagattttcaaagtctgagtgtatttttctgccagataccacaatagaacaaatgagagtaatctctgaccttgccgtgtgctgacttttaggaataccacattgtgaagaagtctacccgctccttaagcacgactcaggtggaatctccttggaggctcattcggccatccgtcatctcgatcattgggttgtacaaagaaaaaggcaagggccttggctttagtattgctggaggtcgagactgcattcgtggacagatggggatttttgtcaagaccatcttcccaaatggatcagctgcagaggacggaagacttaaagaaggggatgaaatcctagatgtaaatggaataccaataaagggcttgacatttcaagaagccattcatacctttaagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaaggtgatagcagctattccttacctttgtctcatttcttgaataacattttggaatctgttgttagcttaattcttccttgttgttctatgaattattcctttggtacaatcttctatcaacaacacgtggtctctgcatgggacagtgaggtcaggtagagagatgttagtcactttagtcaaagtgaagggaagttaccagtagcatggagctctctaagctctccccatgaatcactgtgggtcagaggcttgtgttta

SEQ ID NO: 347541 - DNA, 2752 bp, Homo sapiens
  misc_feature (979)..(979): n is a, c, g, or t
  misc_feature (1811)..(1811): n is a, c, g, or t
  misc_feature (1935)..(1935): n is a, c, g, or t
ttagttatcttcaaaaatgctgtgactgttcagttcaattgacctaaacttcaggtgcttttgtgttatacgggttctttttttggaactgatgagaatgaattggaatctcctattttttaggcagagcaaccatcgaaccctgtatgctaacaataagacatgaccaggcttcattctcccacggcagaatatttatttctgtctcttagaggaagggttaactcccaggtggtgtttgtgttgagttttagaacaatataaaattctaacagagcatttttataatggatgtgccatgtgttcacttaattgaaactcattctgcaaggctggtaaaatggagcaaaacggggaaaaaaaatcaatagttaagaaaggttaatagcacttgattctcctaaatagcgtttttttcatatgtgttcatttacaagaaacgtaagtcattggaatggatttcaacctgttgagtgatacttctttaaaaaactttgcatacattttaagagtgcgagtaatcattttaatatttgctccttttcccctatggaaacaacctgaaaacatccacctcctcacctaattgagtaattggttatgccagatttttaaacagagattacttcacttattttatagcttctgtaattgcattaaggggaagccacataacaaatgcatggggcacagctacatttttgtaactcatctacaggattccttgaattgtgcacagtgtgctcctgggattggctgtctgcgagaggtgacaatgtgtgttcttatgctgctttgcactttcttataggcgtacagagtccctcttctctacagcaatgctgtgcaaagttcatctgttttctctctggggcatctttgtagtgtttttgatgaactgttattccaaaaaagcaggccatgtacaagagtgcaaaccagaaacgagctctgataagtcaacaggatgtccaagttnttttatattcctagcagacgctatcaacagctgaaaaacgacctgactgtgccgccttagagttaaaaataataggagagctggggcagggggccatgtgcgagcatattcctgcacatgcctggcaaattaacatgaccctgcagtcatctctgagatagaagcttatagtaaacttgccagcttactgacagagaacctggaactgcatcagcaagattatttttgggccgggagcagtagctcacacctgtaatccccgcactttgggaagccgaggcgggcagatcactcaaggccaggagttcaagaccagcctggccaacatggtgaaaccctgtctctactaaagatacaaaaaaaaattagccatatatggtggcgtgcacctgtattcccagctattcaggaggctgaggcatgagaatagtttgaacctgggaggcagaggttgtagtgagctgaggtcacgccaccgcactctagcctgggtgactgagccagagcaatactctgtttcaaaaaaaaatttttttttagtaaaaaaaagactgtttctgggctgccattgctcagtaatattttagcaagtttttgttatcattaaagccattttccatacaccatgctgattctctgtgcttggggaacttgtctttctacaaatataggagtgacttctcaaatgttgtatgtgttcatgcctcattgccagtgggtttaagtttttaaacaatgactactttgaactagatttctgcagtttgatttcgaaacataggacatctgttgtcaaacttggcaatggctaaaaaaataagattttcatgcntcccatagttattttaattgaagattgaaatacagaattactgcaaaagaatatgtgttgtcattaattgtcccattttgtgacattcctgggagctaagctaaacaataaaagttattttatntggtagtaaatcagggaccatatggtatcccaaaataagtctgactgagcagttaaattccaggaaattaaaggctaatgttaatgtaattctcacatttgatcactaggggatgaaatcctagatgtaaatggaataccaataaagggcttgacatttcaagaagccattcatacctttaaggtaacaacattcttattgatctcctttatcctattttcctttcttatttccttctggcttgggtttggtgagttgttttttttttttaaccctttgatataaggacattccaaatgtttcagcccacctttcctcactgttttctcagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaaggtgatagcagctattccttacctttgtctcatttcttgaataacattttggaatctgttgttagcttaattcttccttgttgttctatgaattattcctttggtacaatcttctatcaacaacacgtggtctctgcatgggacagtgaggtcaggtagagagatgttagtcactttagtcaaagtgaagggaagttaccagtagcatggagctctctaagctctccccatgaatcactgtgggtcagaggcttgtgttta

SEQ ID NO: 347542 - DNA, 898 bp, Homo sapiens
ctaagaatcatacattctctgtggggaaaaaatggatttgggtttaaattgggtccacacccctggcctttgaggtaaccttgcagacacagaacatttactccatgtagtctttggtttgggagcatgtagcttgactgtgccaggttgccttcaagaactgcttggttctggggagtaattcatggatgggcctttaattgtgtccccataggaaaactccgcagaggacctcctcaggttaacatctaagagcttgccagatctgaccagctcggtagaagatgtgtcctcctggactgataacgaagaccaggaggcagacggggaagaggacgaaggaaccagctcttctgtccagagagcagtaagtggctctgtgctcctggctttctgttggaattacttttttctgaagtcctgggcgccaggattaggggataaatgcttgagatagtatgatagagaccatgatgggaaaagacaccagtgcattctttctatgtttttctcggaatctctgagaaaaatctgtgagggtgatatttttcctttaaggaaaaaaaatgaaatggtaaacaagataagcaacccagggggctgggcacagtggcttacacctgtaatgccagcacttttggaggctgaggcaggtggatcacctgaggtcaggagttcaagaccagcctggccaacatgatgaaacctagtctctactaaaaatacaaaaattagccaggcatggtggtgcatgcctgtaattccagctactcaggaggctgaggcaagagaatcgtcttgagcccaggaggcagaggttgcagtgagctgagatctcgccactgcactcaagcctgggctacagagcgagactccctctccaaaaacctctcaaaaa

SEQ ID NO: 347543 - DNA, 11518 bp, Homo sapiens
  misc_feature (979)..(979): n is a, c, g, or t
  misc_feature (1811)..(1811): n is a, c, g, or t
  misc_feature (1935)..(1935): n is a, c, g, or t
ttagttatcttcaaaaatgctgtgactgttcagttcaattgacctaaacttcaggtgcttttgtgttatacgggttctttttttggaactgatgagaatgaattggaatctcctattttttaggcagagcaaccatcgaaccctgtatgctaacaataagacatgaccaggcttcattctcccacggcagaatatttatttctgtctcttagaggaagggttaactcccaggtggtgtttgtgttgagttttagaacaatataaaattctaacagagcatttttataatggatgtgccatgtgttcacttaattgaaactcattctgcaaggctggtaaaatggagcaaaacggggaaaaaaaatcaatagttaagaaaggttaatagcacttgattctcctaaatagcgtttttttcatatgtgttcatttacaagaaacgtaagtcattggaatggatttcaacctgttgagtgatacttctttaaaaaactttgcatacattttaagagtgcgagtaatcattttaatatttgctccttttcccctatggaaacaacctgaaaacatccacctcctcacctaattgagtaattggttatgccagatttttaaacagagattacttcacttattttatagcttctgtaattgcattaaggggaagccacataacaaatgcatggggcacagctacatttttgtaactcatctacaggattccttgaattgtgcacagtgtgctcctgggattggctgtctgcgagaggtgacaatgtgtgttcttatgctgctttgcactttcttataggcgtacagagtccctcttctctacagcaatgctgtgcaaagttcatctgttttctctctggggcatctttgtagtgtttttgatgaactgttattccaaaaaagcaggccatgtacaagagtgcaaaccagaaacgagctctgataagtcaacaggatgtccaagttnttttatattcctagcagacgctatcaacagctgaaaaacgacctgactgtgccgccttagagttaaaaataataggagagctggggcagggggccatgtgcgagcatattcctgcacatgcctggcaaattaacatgaccctgcagtcatctctgagatagaagcttatagtaaacttgccagcttactgacagagaacctggaactgcatcagcaagattatttttgggccgggagcagtagctcacacctgtaatccccgcactttgggaagccgaggcgggcagatcactcaaggccaggagttcaagaccagcctggccaacatggtgaaaccctgtctctactaaagatacaaaaaaaaattagccatatatggtggcgtgcacctgtattcccagctattcaggaggctgaggcatgagaatagtttgaacctgggaggcagaggttgtagtgagctgaggtcacgccaccgcactctagcctgggtgactgagccagagcaatactctgtttcaaaaaaaaatttttttttagtaaaaaaaagactgtttctgggctgccattgctcagtaatattttagcaagtttttgttatcattaaagccattttccatacaccatgctgattctctgtgcttggggaacttgtctttctacaaatataggagtgacttctcaaatgttgtatgtgttcatgcctcattgccagtgggtttaagtttttaaacaatgactactttgaactagatttctgcagtttgatttcgaaacataggacatctgttgtcaaacttggcaatggctaaaaaaataagattttcatgcntcccatagttattttaattgaagattgaaatacagaattactgcaaaagaatatgtgttgtcattaattgtcccattttgtgacattcctgggagctaagctaaacaataaaagttattttatntggtagtaaatcagggaccatatggtatcccaaaataagtctgactgagcagttaaattccaggaaattaaaggctaatgttaatgtaattctcacatttgatcactaggggatgaaatcctagatgtaaatggaataccaataaagggcttgacatttcaagaagccattcatacctttaaggtaacaacattcttattgatctcctttatcctattttcctttcttatttccttctggcttgggtttggtgagttgttttttttttttaaccctttgatataaggacattccaaatgtttcagcccacctttcctcactgttttctcagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347544 - DNA, 10425 bp, Homo sapiens
  misc_feature (352)..(352): n is a, c, g, or t
agtctgtcccattccagaggctgctgaagcacagcagagcacgctcacctgaccagctcataaagcagttacctggctgagcagtgctggaatggcggctttatctacctgatcatgctgcgtcgctttaagcacaaagcccactccacttataatggcaacagtagcaacagctctgaaccaggagaaacacctaccttggagctgggtgaccgaactgcgaaaaaggggaaacgaaccagaaagtttggggtcatctccaggcctcctgccaacaaggcccctgaagaatccaagggcagcgctggctgtgaggtgtccagtgaccccagcactgagctggagaacggcnctgaccctgaacttggaaacggccatgtctttcagctagaaaatggcccagattctctcaaggaggtggctggaccccatctagagaggtcagaagtggacagagggacagagcatagaattccaaagacagatgctcctctgaccacaagcaatgacaaacgccgcttctcaaaaggtgggaagacggacttccaatcgagtgactgcctggcacggcaggaggaagttggccgaatatggaagatggagctgctcaaagaatcggatgggctgggaattcaggttagtggaggccgaggatcaaagcgctcacctcacgctatcgttgtcactcaagtgaaggaaggaggtgccgctcacaggaataccacattgtgaagaagtctacccgctccttaagcacgactcaggtggaatctccttggaggctcattcggccatccgtcatctcgatcattgggttgtacaaagaaaaaggcaagggccttggctttagtattgctggaggtcgagactgcattcgtggacagatggggatttttgtcaagaccatcttcccaaatggatcagctgcagaggacggaagacttaaagaaggggatgaaatcctagatgtaaatggaataccaataaagggcttgacatttcaagaagccattcatacctttaaggtaacaacattcttattgatctcctttatcctattttcctttcttatttccttctggcttgggtttggtgagttgttttttttttttaaccctttgatataaggacattccaaatgtttcagcccacctttcctcactgttttctcagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347545 - DNA, 7954 bp, Homo sapiens
agcctcccaagtagctgggattacaggcacctgccactgcgcctggctaatttttttgtatttttagtagagacggggtttcaccatgttggccaggctggtctcgaactcctgacctcaggtgatccacccgcctcagcctcccaaagtgctgggattacaagcatgcgccaccacgcccagctttctgaaaaagaaaaaaatatttgaggttgtttataattttctagtttttaataattgaggggctgctttcttatattatcccttttatctcccctacaacctctcctgtgtatgtaccttctgtttacgttctccacgtagaactggacagctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347546 - DNA, 11620 bp, Homo sapiens
  misc_feature (979)..(979): n is a, c, g, or t
  misc_feature (1811)..(1811): n is a, c, g, or t
  misc_feature (1935)..(1935): n is a, c, g, or t
ttagttatcttcaaaaatgctgtgactgttcagttcaattgacctaaacttcaggtgcttttgtgttatacgggttctttttttggaactgatgagaatgaattggaatctcctattttttaggcagagcaaccatcgaaccctgtatgctaacaataagacatgaccaggcttcattctcccacggcagaatatttatttctgtctcttagaggaagggttaactcccaggtggtgtttgtgttgagttttagaacaatataaaattctaacagagcatttttataatggatgtgccatgtgttcacttaattgaaactcattctgcaaggctggtaaaatggagcaaaacggggaaaaaaaatcaatagttaagaaaggttaatagcacttgattctcctaaatagcgtttttttcatatgtgttcatttacaagaaacgtaagtcattggaatggatttcaacctgttgagtgatacttctttaaaaaactttgcatacattttaagagtgcgagtaatcattttaatatttgctccttttcccctatggaaacaacctgaaaacatccacctcctcacctaattgagtaattggttatgccagatttttaaacagagattacttcacttattttatagcttctgtaattgcattaaggggaagccacataacaaatgcatggggcacagctacatttttgtaactcatctacaggattccttgaattgtgcacagtgtgctcctgggattggctgtctgcgagaggtgacaatgtgtgttcttatgctgctttgcactttcttataggcgtacagagtccctcttctctacagcaatgctgtgcaaagttcatctgttttctctctggggcatctttgtagtgtttttgatgaactgttattccaaaaaagcaggccatgtacaagagtgcaaaccagaaacgagctctgataagtcaacaggatgtccaagttnttttatattcctagcagacgctatcaacagctgaaaaacgacctgactgtgccgccttagagttaaaaataataggagagctggggcagggggccatgtgcgagcatattcctgcacatgcctggcaaattaacatgaccctgcagtcatctctgagatagaagcttatagtaaacttgccagcttactgacagagaacctggaactgcatcagcaagattatttttgggccgggagcagtagctcacacctgtaatccccgcactttgggaagccgaggcgggcagatcactcaaggccaggagttcaagaccagcctggccaacatggtgaaaccctgtctctactaaagatacaaaaaaaaattagccatatatggtggcgtgcacctgtattcccagctattcaggaggctgaggcatgagaatagtttgaacctgggaggcagaggttgtagtgagctgaggtcacgccaccgcactctagcctgggtgactgagccagagcaatactctgtttcaaaaaaaaatttttttttagtaaaaaaaagactgtttctgggctgccattgctcagtaatattttagcaagtttttgttatcattaaagccattttccatacaccatgctgattctctgtgcttggggaacttgtctttctacaaatataggagtgacttctcaaatgttgtatgtgttcatgcctcattgccagtgggtttaagtttttaaacaatgactactttgaactagatttctgcagtttgatttcgaaacataggacatctgttgtcaaacttggcaatggctaaaaaaataagattttcatgcntcccatagttattttaattgaagattgaaatacagaattactgcaaaagaatatgtgttgtcattaattgtcccattttgtgacattcctgggagctaagctaaacaataaaagttattttatntggtagtaaatcagggaccatatggtatcccaaaataagtctgactgagcagttaaattccaggaaattaaaggctaatgttaatgtaattctcacatttgatcactaggggatgaaatcctagatgtaaatggaataccaataaagggcttgacatttcaagaagccattcatacctttaaggtaacaacattcttattgatctcctttatcctattttcctttcttatttccttctggcttgggtttggtgagttgttttttttttttaaccctttgatataaggacattccaaatgtttcagcccacctttcctcactgttttctcagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgaaaacacagaacaaaggatgcaagtacagcagcaacacagccaggagggcagccccagaattgggaggccaacagtgctactgggctcaagtgctgttataaggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347547 - DNA, 3082 bp, Homo sapiens
atctgttaacaattagaagctgacagcctgggcaacatggcaagaccccatctctaccaaaaatataaaaaaaaaagctgtgcatggtggtgtatgcctgtggtagcagctactctgaaggctgaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347548 - DNA, 3755 bp, Homo sapiens
gtgaaaccctgtccgtctctcctaacaatacaaaaattaacttggcatagtggtgtgtgcctataatcccagctactcaggaggctgaggcaggagaatcgcttgaacccgggaggctgagattgcaccactgtactccagcctgggtgacacagcgagactccctctcaaaaaataaaaataaaaaaggaaggttcctttactacagatacgcagttagttactatctcccttttaccggaaatcgtaagtggatctggtttttgttcccttttcctttcctcatcccaggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgaaaacacagaacaaaggatgcaagtacagcagcaacacagccaggagggcagccccagaattgggaggccaacagtgctactgggctcaagtgctgttataaggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347549 - DNA, 11533 bp, Homo sapiens
  misc_feature (979)..(979): n is a, c, g, or t
  misc_feature (1811)..(1811): n is a, c, g, or t
  misc_feature (1935)..(1935): n is a, c, g, or t
ttagttatcttcaaaaatgctgtgactgttcagttcaattgacctaaacttcaggtgcttttgtgttatacgggttctttttttggaactgatgagaatgaattggaatctcctattttttaggcagagcaaccatcgaaccctgtatgctaacaataagacatgaccaggcttcattctcccacggcagaatatttatttctgtctcttagaggaagggttaactcccaggtggtgtttgtgttgagttttagaacaatataaaattctaacagagcatttttataatggatgtgccatgtgttcacttaattgaaactcattctgcaaggctggtaaaatggagcaaaacggggaaaaaaaatcaatagttaagaaaggttaatagcacttgattctcctaaatagcgtttttttcatatgtgttcatttacaagaaacgtaagtcattggaatggatttcaacctgttgagtgatacttctttaaaaaactttgcatacattttaagagtgcgagtaatcattttaatatttgctccttttcccctatggaaacaacctgaaaacatccacctcctcacctaattgagtaattggttatgccagatttttaaacagagattacttcacttattttatagcttctgtaattgcattaaggggaagccacataacaaatgcatggggcacagctacatttttgtaactcatctacaggattccttgaattgtgcacagtgtgctcctgggattggctgtctgcgagaggtgacaatgtgtgttcttatgctgctttgcactttcttataggcgtacagagtccctcttctctacagcaatgctgtgcaaagttcatctgttttctctctggggcatctttgtagtgtttttgatgaactgttattccaaaaaagcaggccatgtacaagagtgcaaaccagaaacgagctctgataagtcaacaggatgtccaagttnttttatattcctagcagacgctatcaacagctgaaaaacgacctgactgtgccgccttagagttaaaaataataggagagctggggcagggggccatgtgcgagcatattcctgcacatgcctggcaaattaacatgaccctgcagtcatctctgagatagaagcttatagtaaacttgccagcttactgacagagaacctggaactgcatcagcaagattatttttgggccgggagcagtagctcacacctgtaatccccgcactttgggaagccgaggcgggcagatcactcaaggccaggagttcaagaccagcctggccaacatggtgaaaccctgtctctactaaagatacaaaaaaaaattagccatatatggtggcgtgcacctgtattcccagctattcaggaggctgaggcatgagaatagtttgaacctgggaggcagaggttgtagtgagctgaggtcacgccaccgcactctagcctgggtgactgagccagagcaatactctgtttcaaaaaaaaatttttttttagtaaaaaaaagactgtttctgggctgccattgctcagtaatattttagcaagtttttgttatcattaaagccattttccatacaccatgctgattctctgtgcttggggaacttgtctttctacaaatataggagtgacttctcaaatgttgtatgtgttcatgcctcattgccagtgggtttaagtttttaaacaatgactactttgaactagatttctgcagtttgatttcgaaacataggacatctgttgtcaaacttggcaatggctaaaaaaataagattttcatgcntcccatagttattttaattgaagattgaaatacagaattactgcaaaagaatatgtgttgtcattaattgtcccattttgtgacattcctgggagctaagctaaacaataaaagttattttatntggtagtaaatcagggaccatatggtatcccaaaataagtctgactgagcagttaaattccaggaaattaaaggctaatgttaatgtaattctcacatttgatcactaggggatgaaatcctagatgtaaatggaataccaataaagggcttgacatttcaagaagccattcatacctttaaggtaacaacattcttattgatctcctttatcctattttcctttcttatttccttctggcttgggtttggtgagttgttttttttttttaaccctttgatataaggacattccaaatgtttcagcccacctttcctcactgttttctcagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgaaaacacagaacaaaggatgcaagtacagcagcaacacagccaggagggcagccccagaattgggaggccaacagtgctactgggctcaagtgctgttataaggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgcctgagtgatatctacagcgctatcgctgcttatcaatatcgtagtcgtcgcgat

SEQ ID NO: 347550 - DNA, 1517 bp, Homo sapiens
agctgttccagagtatccctggtaaacctggatcgccacgtactacgagagttggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347551 - DNA, 1367 bp, Homo sapiens
atgcatgctgttccttgttactttgatatccgcaaggtaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347552 - DNA, 8330 bp, Homo sapiens
  misc_feature (979)..(979): n is a, c, g, or t
  misc_feature (1811)..(1811): n is a, c, g, or t
  misc_feature (1935)..(1935): n is a, c, g, or t
ttagttatcttcaaaaatgctgtgactgttcagttcaattgacctaaacttcaggtgcttttgtgttatacgggttctttttttggaactgatgagaatgaattggaatctcctattttttaggcagagcaaccatcgaaccctgtatgctaacaataagacatgaccaggcttcattctcccacggcagaatatttatttctgtctcttagaggaagggttaactcccaggtggtgtttgtgttgagttttagaacaatataaaattctaacagagcatttttataatggatgtgccatgtgttcacttaattgaaactcattctgcaaggctggtaaaatggagcaaaacggggaaaaaaaatcaatagttaagaaaggttaatagcacttgattctcctaaatagcgtttttttcatatgtgttcatttacaagaaacgtaagtcattggaatggatttcaacctgttgagtgatacttctttaaaaaactttgcatacattttaagagtgcgagtaatcattttaatatttgctccttttcccctatggaaacaacctgaaaacatccacctcctcacctaattgagtaattggttatgccagatttttaaacagagattacttcacttattttatagcttctgtaattgcattaaggggaagccacataacaaatgcatggggcacagctacatttttgtaactcatctacaggattccttgaattgtgcacagtgtgctcctgggattggctgtctgcgagaggtgacaatgtgtgttcttatgctgctttgcactttcttataggcgtacagagtccctcttctctacagcaatgctgtgcaaagttcatctgttttctctctggggcatctttgtagtgtttttgatgaactgttattccaaaaaagcaggccatgtacaagagtgcaaaccagaaacgagctctgataagtcaacaggatgtccaagttnttttatattcctagcagacgctatcaacagctgaaaaacgacctgactgtgccgccttagagttaaaaataataggagagctggggcagggggccatgtgcgagcatattcctgcacatgcctggcaaattaacatgaccctgcagtcatctctgagatagaagcttatagtaaacttgccagcttactgacagagaacctggaactgcatcagcaagattatttttgggccgggagcagtagctcacacctgtaatccccgcactttgggaagccgaggcgggcagatcactcaaggccaggagttcaagaccagcctggccaacatggtgaaaccctgtctctactaaagatacaaaaaaaaattagccatatatggtggcgtgcacctgtattcccagctattcaggaggctgaggcatgagaatagtttgaacctgggaggcagaggttgtagtgagctgaggtcacgccaccgcactctagcctgggtgactgagccagagcaatactctgtttcaaaaaaaaatttttttttagtaaaaaaaagactgtttctgggctgccattgctcagtaatattttagcaagtttttgttatcattaaagccattttccatacaccatgctgattctctgtgcttggggaacttgtctttctacaaatataggagtgacttctcaaatgttgtatgtgttcatgcctcattgccagtgggtttaagtttttaaacaatgactactttgaactagatttctgcagtttgatttcgaaacataggacatctgttgtcaaacttggcaatggctaaaaaaataagattttcatgcntcccatagttattttaattgaagattgaaatacagaattactgcaaaagaatatgtgttgtcattaattgtcccattttgtgacattcctgggagctaagctaaacaataaaagttattttatntggtagtaaatcagggaccatatggtatcccaaaataagtctgactgagcagttaaattccaggaaattaaaggctaatgttaatgtaattctcacatttgatcactaggggatgaaatcctagatgtaaatggaataccaataaagggcttgacatttcaagaagccattcatacctttaaggtaacaacattcttattgatctcctttatcctattttcctttcttatttccttctggcttgggtttggtgagttgttttttttttttaaccctttgatataaggacattccaaatgtttcagcccacctttcctcactgttttctcagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcaagggctctgattcggaactcggtcagaggtg

SEQ ID NO: 347553 - DNA, 1058 bp, Homo sapiens
gagaagtgtggcgtctcggtccaggatgcaggtccctgattcgggttggacgtggtcatcaaacccagaaattgaaggatcttgggcctgccttgatgttcatttctctcatctataaaattgaaggctggaggaggtgtgaatgagcccagggaaggacacacggccactgctggagggatcctccattcctgtgtcatttgcatgggtcctgctgtgaaatgaacctggcagggacttgttagacacttccttccttccctcattgagcactccagtgccattgttccacagttgttctaattgggtcctagcttcctcctgccaaggcaaacagcatagtctcgagtaggtgtccctaggctcatctgccagcctgaacatgaacacaggcaaagctgatgatggccagggaccccaggggacgtggggccctgtggggtctggcccccaggagcaagacctctgatgatgctggtgtctgggagtgagcaccatgcccatcacccaggacaatgccgtgctgcacctgcccctcctctaccagtggctgcagaacagcctgcaggaaggtggggatgggccggagcagcggctctgccaggcggccatccagaagctgcaggagtacatccagctgaactttgctgtggatgagagtacggtcccacctgatcacagcccccccgaaatggagatctgtactgtgtacctcaccaaggagctgggggacacagagactgtgggcctgagttttgggaacatccctgttttcggggactatggtgaaaagcgcagggggggcaagaagaggaaaacccaccagggtcctgtgctggatgtgggctgcatctgggtgacagagctgaggaagaacagcccagcagggaagagtgggaaggtccgactgcgggatgagatcctctcactgaatgggcagctgatggttggagttgatgtcagtggggccaggtaagtagggggaatgcctgctggcacaggggctggacacgggaacctggtggttcccagatctgcagctgcagaggtttatgaat

SEQ ID NO: 347554 - DNA, 11218 bp, Homo sapiens
  misc_feature (1256)..(1256): n is a, c, g, or t
gagaagtgtggcgtctcggtccaggatgcaggtccctgattcgggttggacgtggtcatcaaacccagaaattgaaggatcttgggcctgccttgatgttcatttctctcatctataaaattgaaggctggaggaggtgtgaatgagcccagggaaggacacacggccactgctggagggatcctccattcctgtgtcatttgcatgggtcctgctgtgaaatgaacctggcagggacttgttagacacttccttccttccctcattgagcactccagtgccattgttccacagttgttctaattgggtcctagcttcctcctgccaaggcaaacagcatagtctcgagtaggtgtccctaggctcatctgccagcctgaacatgaacacaggcaaagctgatgatggccagggaccccaggggacgtggggccctgtggggtctggcccccaggagcaagacctctgatgatgctggtgtctgggagtgagcaccatgcccatcacccaggacaatgccgtgctgcacctgcccctcctctaccagtggctgcagaacagcctgcaggaaggtggggatgggccggagcagcggctctgccaggcggccatccagaagctgcaggagtacatccagctgaactttgctgtggatgagagtacggtcccacctgatcacagcccccccgaaatggagatctgtactgtgtacctcaccaaggagctgggggacacagagactgtgggcctgagttttgggaacatccctgttttcggggactatggtgaaaagcgcagggggggcaagaagaggaaaacccaccagggtcctgtgctggatgtgggctgcatctgggtgacagagctgaggaagaacagcccagcagggaagagtgggaaggtccgactgcgggatgagatcctctcactgaatgggcagctgatggttggagttgatgtcagtggggccagttacctggctgagcagtgctggaatggcggctttatctacctgatcatgctgcgtcgctttaagcacaaagcccactccacttataatggcaacagtagcaacagctctgaaccaggagaaacacctaccttggagctgggtgaccgaactgcgaaaaaggggaaacgaaccagaaagtttggggtcatctccaggcctcctgccaacaaggcccctgaagaatccaagggcagcgctggctgtgaggtgtccagtgaccccagcactgagctggagaacggcnctgaccctgaacttggaaacggccatgtctttcagctagaaaatggcccagattctctcaaggaggtggctggaccccatctagagaggtcagaagtggacagagggacagagcatagaattccaaagacagatgctcctctgaccacaagcaatgacaaacgccgcttctcaaaaggtgggaagacggacttccaatcgagtgactgcctggcacggcaggaggaagttggccgaatatggaagatggagctgctcaaagaatcggatgggctgggaattcaggttagtggaggccgaggatcaaagcgctcacctcacgctatcgttgtcactcaagtgaaggaaggaggtgccgctcacaggaataccacattgtgaagaagtctacccgctccttaagcacgactcaggtggaatctccttggaggctcattcggccatccgtcatctcgatcattgggttgtacaaagaaaaaggcaagggccttggctttagtattgctggaggtcgagactgcattcgtggacagatggggatttttgtcaagaccatcttcccaaatggatcagctgcagaggacggaagacttaaagaaggggatgaaatcctagatgtaaatggaataccaataaagggcttgacatttcaagaagccattcatacctttaagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctgtttccgagcaggaaatggatgaagtcatagcacgcagcacttatcaggagagcaaagaggccaattcctctcctggcttaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347555 - DNA, 9678 bp, Homo sapiens
gaaatgtctagtactgaagacatctaagattttcaaagtctgagtgtatttttctgccagataccacaatagaacaaatgagagtaatctctgaccttgccgtgtgctgacttttaggaataccacattgtgaagaagtctacccgctccttaagcacgactcaggtggaatctccttggaggctcattcggccatccgtcatctcgatcattgggttgtacaaagaaaaaggcaagggccttggctttagtattgctggaggtcgagactgcattcgtggacagatggggatttttgtcaagaccatcttcccaaatggatcagctgcagaggacggaagacttaaagaaggggatgaaatcctagatgtaaatggaataccaataaagggcttgacatttcaagaagccattcatacctttaagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactac

SEQ ID NO: 347556 - DNA, 11820 bp, Homo sapiens
  misc_feature (979)..(979): n is a, c, g, or t
  misc_feature (1811)..(1811): n is a, c, g, or t
  misc_feature (1935)..(1935): n is a, c, g, or t
ttagttatcttcaaaaatgctgtgactgttcagttcaattgacctaaacttcaggtgcttttgtgttatacgggttctttttttggaactgatgagaatgaattggaatctcctattttttaggcagagcaaccatcgaaccctgtatgctaacaataagacatgaccaggcttcattctcccacggcagaatatttatttctgtctcttagaggaagggttaactcccaggtggtgtttgtgttgagttttagaacaatataaaattctaacagagcatttttataatggatgtgccatgtgttcacttaattgaaactcattctgcaaggctggtaaaatggagcaaaacggggaaaaaaaatcaatagttaagaaaggttaatagcacttgattctcctaaatagcgtttttttcatatgtgttcatttacaagaaacgtaagtcattggaatggatttcaacctgttgagtgatacttctttaaaaaactttgcatacattttaagagtgcgagtaatcattttaatatttgctccttttcccctatggaaacaacctgaaaacatccacctcctcacctaattgagtaattggttatgccagatttttaaacagagattacttcacttattttatagcttctgtaattgcattaaggggaagccacataacaaatgcatggggcacagctacatttttgtaactcatctacaggattccttgaattgtgcacagtgtgctcctgggattggctgtctgcgagaggtgacaatgtgtgttcttatgctgctttgcactttcttataggcgtacagagtccctcttctctacagcaatgctgtgcaaagttcatctgttttctctctggggcatctttgtagtgtttttgatgaactgttattccaaaaaagcaggccatgtacaagagtgcaaaccagaaacgagctctgataagtcaacaggatgtccaagttnttttatattcctagcagacgctatcaacagctgaaaaacgacctgactgtgccgccttagagttaaaaataataggagagctggggcagggggccatgtgcgagcatattcctgcacatgcctggcaaattaacatgaccctgcagtcatctctgagatagaagcttatagtaaacttgccagcttactgacagagaacctggaactgcatcagcaagattatttttgggccgggagcagtagctcacacctgtaatccccgcactttgggaagccgaggcgggcagatcactcaaggccaggagttcaagaccagcctggccaacatggtgaaaccctgtctctactaaagatacaaaaaaaaattagccatatatggtggcgtgcacctgtattcccagctattcaggaggctgaggcatgagaatagtttgaacctgggaggcagaggttgtagtgagctgaggtcacgccaccgcactctagcctgggtgactgagccagagcaatactctgtttcaaaaaaaaatttttttttagtaaaaaaaagactgtttctgggctgccattgctcagtaatattttagcaagtttttgttatcattaaagccattttccatacaccatgctgattctctgtgcttggggaacttgtctttctacaaatataggagtgacttctcaaatgttgtatgtgttcatgcctcattgccagtgggtttaagtttttaaacaatgactactttgaactagatttctgcagtttgatttcgaaacataggacatctgttgtcaaacttggcaatggctaaaaaaataagattttcatgcntcccatagttattttaattgaagattgaaatacagaattactgcaaaagaatatgtgttgtcattaattgtcccattttgtgacattcctgggagctaagctaaacaataaaagttattttatntggtagtaaatcagggaccatatggtatcccaaaataagtctgactgagcagttaaattccaggaaattaaaggctaatgttaatgtaattctcacatttgatcactaggggatgaaatcctagatgtaaatggaataccaataaagggcttgacatttcaagaagccattcatacctttaaggtaacaacattcttattgatctcctttatcctattttcctttcttatttccttctggcttgggtttggtgagttgttttttttttttaaccctttgatataaggacattccaaatgtttcagcccacctttcctcactgttttctcagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtccacagggtgttttctcagggggcggcttctcaggaagggactatgaaccgaggggatttccttctgtcagtcaacggcgcctcactggctggcttagcccacgggaatgtcctgaaggttctgcaccaggcacagctgcacaaagatgccctcgtggtcatcaagaaagggatggatcagcccaggccctctgcccggcaggagcctcccacagccaatgggaagggtttgctgtccagaaagaccatccccctggagcctggcattgaaaacacagaacaaaggatgcaagtacagcagcaacacagccaggagggcagccccagaattgggaggccaacagtgctactgggctcaagtgctgttataaggagaagtgtggctgtacacgatgctctgtgtgttgaagtgctgaagacctcggctgggctgggactgagtctggatgggggaaaatcatcggtgacgggagatgggcccttggtcattaaaagagtgtacaaaggtggtgcggctgaacaagctggaataatagaagctggagatgaaattcttgctattaatgggaaacctctggttgggctcatgcactttgatgcctggaatattatgaagtctgtcccagaaggacctgtgcagttattaattagaaagcataggaattcttcatgaattttaacaagaatcattttctcagttctcttctttctttagcaaatcagagtgacttctttaaaccacaggttgttgaaatggccaacactggtacagacacggactataaaaatctccaagcttgtgcttacacatgaagcctgacttaactgtatgtgcaacagcaatgaaattaactccagaagccttccacctgcgtcacccaggccgggagggttccttcgttccagtgcctgtcccctacctttatgttatgtttactgatggggatacaagatgtgacacacccttctttatttgaaacaaacaaacatttagctagacctttgcttccttcttgccagctctcccaacatacccaatcctggtgatcagggaactaaaagtctgagggggacacaaatgtcacacctaagaggacaatcaatcattttgtatgattttgtaagtaagtaaatgacagaatgcttttaggcacattcaatggaaggaggagatgtaggtctgtatatgttaccctgaaaagagaataagacttacttaaaaaaatgaattatgacctgttaggctgagctcaggaattgtccaaaaaggaaaaagcaaaataattaattgagagtattttttagtgagtgtaatgtataatgtacgtatgcaaagttcaactcaataggttattgatcaccatgaagtattgatcattttctatctcaaaagtgtaagccataaggctgttttacagaatagcacttctgataagctgtattaaatagccatgagcttcactgcttagagggagcagaaaggtcaacatctaaaagcaccttacaactagtttttgaacctgtcttgataagtgcttgaattcaagactggtcagtacaagagcagacaaaaatatcacaagtcagtcactgggtttccatttctgaattttatgcactccaaccatgaatttaaactaaatttttagaaatcaagtatctttctaagtgtccttggatttatagacaatgtatgtacaatccaaatagaggagcttaatggaatccttttaggagactggttggtttttttccctctttcccaacatgtttaagaaatgtaacattctaagtattggatctcttttcttgacctagtataatgacaactgcagtgacttaagtttttgctgttttcgttttcccgctttgcaatttcctccttttgccaaaaatgttttcctacagaagactgtcgtgactcacgctacttgggaaactcactctggccactcctcctctggtggcatgagctgcttcccagtagctattccgattggatattccgttcgtcgtcacatagctggcttttctctcctcatgatgtaccttattttcttaggtaaataattccaaactctcatcgggtcataaagaggaggagaaacagggtgagtcaaggtaaaggagcagaaatgtagttacaagccaggtcgtcttcagtggcacaaaccaacccgttgagccctgacaacatgagtggagagtgcatttgccatacctgtgtgcatgacactaagattttatgttggagatacttctttaaataacctacagcttgggtctatggctgtgacccccagattcatggaggggctttagccatcagctttgtacatcatcatttttctgaatgaccaatcccactaaacatctttgaagtcggcctagagaggtccttcagatgagagagaaatagctggcttgtctgagtccagatttctcatcaactggcaatacaaaggaaaatatggtacaggagttagttagaaaggtcttattgattttacttctacttttcactacagttacaggtagaatactgtaggaagtcagtgcaaggtgcatgcttgattgatagatattgattgtttttcagtctctggggtcagttttgtggtttctgctttcttgcctaaatcaaagactatttcaagtcaacaacactgaaaactgcttttcgcctccactcttacagctgtgcctaataataattaattaataaacgcacagccctatgtgaacagacaggaatttcttgtgcaatgtggagcaaatggaatggtctccttccgcaagtctttttaatcctcatatctggagtacaagggtagacctctggcttaccacatacactatgctaaagtcatcagccactgctactacatcttgccagaaggtttccctcgccaacaaacagttgaaatttaagggaagaagcaaaagctaaactgtctttgaccctaagatagatagaaagctatttatttgtcttcagtgttcaaggcatgactagtatttctaattagcctaataaattcccacactttctgaagtgaacactaatggtattgtcctactaaaactgtcattgtttctttttttttaactggtcagtcattcacaataagctatgagggtaaataaatatgtgttataacaagtaaaccgtagttgcaagaatataccatgaagattaaagtaggctgggtttcatttccatcttcccacacatctcattgaatttgatggttgacttaattggcaccataactttgtatgatattatacattaacctttatttatgtaaagtaaaatgccttatatattaaagagtaagtgcaataatatgaaatagcctgtacattttaaaaatgttgtcaccaagttatataaatccacatctctgtaaacaaccttttttaagtaattttaaaaaaaataaacactctgcttactacttgattttttttttctcttttggctgtttgtttgttaataatagagtaatattgagatgagaaatgtttattgtcacctaaatgcatcagaggtacaaaggcaatagaactcaaattagccacccttttccaggccacactcacaatcttgacacaatccaaaacttttccacctctaaatctttcttacaattgaacat

SEQ ID NO: 347557 - DNA, 8736 bp, Homo sapiens
  misc_feature (979)..(979): n is a, c, g, or t
  misc_feature (1811)..(1811): n is a, c, g, or t
  misc_feature (1935)..(1935): n is a, c, g, or t
ttagttatcttcaaaaatgctgtgactgttcagttcaattgacctaaacttcaggtgcttttgtgttatacgggttctttttttggaactgatgagaatgaattggaatctcctattttttaggcagagcaaccatcgaaccctgtatgctaacaataagacatgaccaggcttcattctcccacggcagaatatttatttctgtctcttagaggaagggttaactcccaggtggtgtttgtgttgagttttagaacaatataaaattctaacagagcatttttataatggatgtgccatgtgttcacttaattgaaactcattctgcaaggctggtaaaatggagcaaaacggggaaaaaaaatcaatagttaagaaaggttaatagcacttgattctcctaaatagcgtttttttcatatgtgttcatttacaagaaacgtaagtcattggaatggatttcaacctgttgagtgatacttctttaaaaaactttgcatacattttaagagtgcgagtaatcattttaatatttgctccttttcccctatggaaacaacctgaaaacatccacctcctcacctaattgagtaattggttatgccagatttttaaacagagattacttcacttattttatagcttctgtaattgcattaaggggaagccacataacaaatgcatggggcacagctacatttttgtaactcatctacaggattccttgaattgtgcacagtgtgctcctgggattggctgtctgcgagaggtgacaatgtgtgttcttatgctgctttgcactttcttataggcgtacagagtccctcttctctacagcaatgctgtgcaaagttcatctgttttctctctggggcatctttgtagtgtttttgatgaactgttattccaaaaaagcaggccatgtacaagagtgcaaaccagaaacgagctctgataagtcaacaggatgtccaagttnttttatattcctagcagacgctatcaacagctgaaaaacgacctgactgtgccgccttagagttaaaaataataggagagctggggcagggggccatgtgcgagcatattcctgcacatgcctggcaaattaacatgaccctgcagtcatctctgagatagaagcttatagtaaacttgccagcttactgacagagaacctggaactgcatcagcaagattatttttgggccgggagcagtagctcacacctgtaatccccgcactttgggaagccgaggcgggcagatcactcaaggccaggagttcaagaccagcctggccaacatggtgaaaccctgtctctactaaagatacaaaaaaaaattagccatatatggtggcgtgcacctgtattcccagctattcaggaggctgaggcatgagaatagtttgaacctgggaggcagaggttgtagtgagctgaggtcacgccaccgcactctagcctgggtgactgagccagagcaatactctgtttcaaaaaaaaatttttttttagtaaaaaaaagactgtttctgggctgccattgctcagtaatattttagcaagtttttgttatcattaaagccattttccatacaccatgctgattctctgtgcttggggaacttgtctttctacaaatataggagtgacttctcaaatgttgtatgtgttcatgcctcattgccagtgggtttaagtttttaaacaatgactactttgaactagatttctgcagtttgatttcgaaacataggacatctgttgtcaaacttggcaatggctaaaaaaataagattttcatgcntcccatagttattttaattgaagattgaaatacagaattactgcaaaagaatatgtgttgtcattaattgtcccattttgtgacattcctgggagctaagctaaacaataaaagttattttatntggtagtaaatcagggaccatatggtatcccaaaataagtctgactgagcagttaaattccaggaaattaaaggctaatgttaatgtaattctcacatttgatcactaggggatgaaatcctagatgtaaatggaataccaataaagggcttgacatttcaagaagccattcatacctttaaggtaacaacattcttattgatctcctttatcctattttcctttcttatttccttctggcttgggtttggtgagttgttttttttttttaaccctttgatataaggacattccaaatgtttcagcccacctttcctcactgttttctcagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactgctcctcggacctcatctcttccccagggaagaagggggccgctcatcctgaccccagcaagacctctgtagacacagggcaagtcagtcggccagagaatcccagccagcctgcatcgcccagggtcgccaagtgcaaggccaggtctccagtcaggctcccccatgagggcagcccctccccgggggagaaagcagcggctccccctgactacagcaagactcgatcagcatcggaaaccagcacaccccacaataccaggagggtggctgccctcaggggagcgggacctggagcagagggaatgacaccagctggtgctgtcctgccaggagaccccctcacatcccaggagcagagacagggagctccaggtaaccacagtaaggctctggaaatgacaggaatccatgcacctgaaagctcccaggagccttccctgctggagggagcagattctgtgtcctcaagggcaccgcaggccagcctctccatgctgccatccactgacaacaccaaagaagcatgtggccatgtctcggggcactgctgcccgggggggagtagagagagccctgtgacggacattgacagcttcatcaaggagctggatgcttctgcagcaaggtctccgtcttcccagacgggggacagtggctctcaggagggcagtgctcagggccacccaccagccggggctggaggtgggagctcctgccgtgccgaaccagtcccggggggccagacctcctccccgaggagggcctgggctgctggtgcccccgcctacccacaatgggcctcccagccttcggttttagattcaattaatcccgacaaacattttactgtgaacaaaaactttctgagcaactactctagaaattttagcagttttcatgaagacagcacctccctatcaggcctgggtgacagcacggagccgtctctgtcatccatgtatggcgatgctgaggattcttcttctgaccctgagtcactcactgaagccccacgagcttctgccagggacggctggtcccctcctcgttcccgtgtgtctttgcacaaggaagatccttcggagtcagaagaggaacagattgagatttgttccacacgtggctgccccaatccaccctcgagtcctgctcatcttcccacccaggctgccatctgtcctgcctcagccaaagttctgtcattaaaatacagcactccgagagagtcggtggccagtccccgtgagaaggccgcctgcttgccaggctcatacacttcaggcccagactcttcccagccatcatcactcttggagatgagctctcaggagcatgaaactcatgcggacataagcacttcacagaaccacaggccctcgtgtgcagaagaaaccacagaagtcaccagcgctagctcagccatggaaaacagtccgctgtctaaagtagccaggcattttcacagtccgcccatcattctcagctcccccaacatggtaaatggcttggaacatgacctgctagatgacgaaaccctgaatcaatacgaaacaagcattaatgcagctgccagtctgtcctccttcagtgtggatgtccctaagaatggagaatctgttttggaaaacctccacatctctgaaagtcaagacctggatgacttgctacagaaaccaaaaatgatcgctaggaggcccatcatggcctggtttaaagaaataaataaacataaccaaggcacacatttgaggagcaaaaccgagaaggaacaacctctaatgcctgccagaagtcccgactccaagattcagatggtgagttcaagccaaaaaaagggcgttactgtgcctcatagccctcctcagccgaaaacaaacctggaaaataaggacctgtctaagaagagtccggcagaaatgcttctgactaatggtcagaaggcaaagtgtggtccgaagctgaagaggctcagcctcaagggcaaggccaaagtcaactctgaggcccctgctgcgaatgctgtgaaggctggggggacggaccacaggaaacccttgatctcaccccagacctcccacaaaacactttctaaggcagtgtcacagcggctccatgtagccgaccacgaggaccctgacagaaacaccacagctgcccccaggtccccccagtgtgtgctggaaagcaagccacctcttgccacctctgggccactgaaaccctcagtgtctgacacgagcatcaggacatttgtctcgcccctgacctctcccaagcctgttcctgagcaaggcatgtggagcaggttccacatggctgtcctctctgaacccgacagaggttgcccaaccacccctaaatctcctaagtgtagagcagagggcagggcgccccgtgctgactccgggccggtgagtccggcagcgtctaggaacggcatgtccgtggcagggaacagacagagtgagccgcgcctggccagccatgtggcagcagacacagcccaacccaggccgactggcgaaaaaggaggcaacataatggccagcgatcgcctcgaaagaacaaaccagctgaaaatcgtggagatttctgctgaagcagtgtcagagactgtatgtggtaacaagccagctgaaagcgacagacggggagggtgcttggcccagggcaactgtcaggagaagagtgaaatcaggctctatcgccaggtcgcagaatcatccacaagtcatccatcctcactcccatctcatgcctcccaggcagagcaggaaatgtcacgatcattcagcatggcaaaactggcgtcctcctcctcctcccttcaaacagccattagaaaggcagaatactcccagggaaaatcaagcctgatgtcagactcccgaggggtgcccagaaacagcattccagggggcccctcgggggaggaccatctctacttcaccccaaggccagcgaccaggacctactccatgccagcccagttctcaagccattttggacgggagggtcaccccccacacagcctgggtcgctctcgggacagccaggtccctgtgacaagcagtgttgtccccgaggcaaaggcatccagaggtggtcttcccagcctggctaatggacagggcatatatagtgtaaagccgctgctggacacatcgaggaatcttccagccacagatgaaggggatatcatttcagtccaggagacgagctgcctagtcacagacaaaatcaaagtcaccagacgacactactgctatgagcagaactggccccatgaatctacctcatttttctctgtgaagcagcggatcaagtcttttgagaacctggccaatgctgaccggcctgtagccaagtccggggcttccccatttttgtcggtgagctccaagcctcccattgggaggcggtcttccggcagcattgtttccgggagcctgggccacccaggtgacgcagcagcaaggttgttgagacgcagcttgagttcctgcagcgaaaaccaaagcgaagccggcaccctcctgccccagatggccaagtctccctcaatcatgacactgaccatctctcggcagaacccaccagagaccagtagcaagggctctgattcggaactaaagaaatcacttggtcctttgggaattcccaccccaacgatgaccctggcttctcctgttaagaggaacaagtcctcggtacgccacacgcagccctcgcccgtgtcccgctccaagctccaggagctgagagccttgagcatgcctgaccttgacaagctctgcagcgaggattactcagcagggccgagcgccgtgctcttcaaaactgagctggagatcacccccaggaggtcacctggccctcctgctggaggcgtttcgtgtcccgagaagggcgggaacagggcctgtccaggaggaagtggccctaaaaccagtgctgctgagacacccagttcagccagtgatacgggtgaagctgcccaggatctgccttttagaagaagctggtcagttaatttggatcaacttctagtctcagcgggggaccagcaaagattacagtctgttttatcgtcagtgggatcgaaatctaccatcctaactctcattcaggaagcgaaagcacaatcagagaatgaagcagatgtttgcttcatagtcttgaatagaaaagaaggctcaggtctgggattcagtgtggcaggagggacagatgtggagccaaaatcaatcacggtaagtgacagagtcattaggctctcaggaaaatcccccctcaagcagcctcagaatgtgatcagggcacaaattccaatcagcgggttcagagattgctggatttcattcccagctaccaacataaaaagggagaagtgggagaagtagtacgtaaggttttcgttgacaaaagacaagcatttttaacacagagctgacatgtataggccatttccaatccctataaacacaattcgctatagccttataatttacctccatattttaagcagtagaaaacattagaatcaactggccaaacttgtgtttatacaattactcccgtctcaaaaagtcactcaaaattttacatcattcaaaagccttcaggaccatccagagggtcaccttcactgcacgagcccaggcctcattcatcttcgtattcccattgcctcctggatgccaggcccatgtcagacactaaaaaggagttaaaaaaaaatgtgtggagacactggcattgacatttgtgttccatcccccgcactgaatgtatgtttttttttataaagcaagtgtctaccttagaaagttc

SEQ ID NO: 347558 - DNA, 4126 bp, Homo sapiens
  misc_feature (979)..(979): n is a, c, g, or t
  misc_feature (1811)..(1811): n is a, c, g, or t
  misc_feature (1935)..(1935): n is a, c, g, or t
ttagttatcttcaaaaatgctgtgactgttcagttcaattgacctaaacttcaggtgcttttgtgttatacgggttctttttttggaactgatgagaatgaattggaatctcctattttttaggcagagcaaccatcgaaccctgtatgctaacaataagacatgaccaggcttcattctcccacggcagaatatttatttctgtctcttagaggaagggttaactcccaggtggtgtttgtgttgagttttagaacaatataaaattctaacagagcatttttataatggatgtgccatgtgttcacttaattgaaactcattctgcaaggctggtaaaatggagcaaaacggggaaaaaaaatcaatagttaagaaaggttaatagcacttgattctcctaaatagcgtttttttcatatgtgttcatttacaagaaacgtaagtcattggaatggatttcaacctgttgagtgatacttctttaaaaaactttgcatacattttaagagtgcgagtaatcattttaatatttgctccttttcccctatggaaacaacctgaaaacatccacctcctcacctaattgagtaattggttatgccagatttttaaacagagattacttcacttattttatagcttctgtaattgcattaaggggaagccacataacaaatgcatggggcacagctacatttttgtaactcatctacaggattccttgaattgtgcacagtgtgctcctgggattggctgtctgcgagaggtgacaatgtgtgttcttatgctgctttgcactttcttataggcgtacagagtccctcttctctacagcaatgctgtgcaaagttcatctgttttctctctggggcatctttgtagtgtttttgatgaactgttattccaaaaaagcaggccatgtacaagagtgcaaaccagaaacgagctctgataagtcaacaggatgtccaagttnttttatattcctagcagacgctatcaacagctgaaaaacgacctgactgtgccgccttagagttaaaaataataggagagctggggcagggggccatgtgcgagcatattcctgcacatgcctggcaaattaacatgaccctgcagtcatctctgagatagaagcttatagtaaacttgccagcttactgacagagaacctggaactgcatcagcaagattatttttgggccgggagcagtagctcacacctgtaatccccgcactttgggaagccgaggcgggcagatcactcaaggccaggagttcaagaccagcctggccaacatggtgaaaccctgtctctactaaagatacaaaaaaaaattagccatatatggtggcgtgcacctgtattcccagctattcaggaggctgaggcatgagaatagtttgaacctgggaggcagaggttgtagtgagctgaggtcacgccaccgcactctagcctgggtgactgagccagagcaatactctgtttcaaaaaaaaatttttttttagtaaaaaaaagactgtttctgggctgccattgctcagtaatattttagcaagtttttgttatcattaaagccattttccatacaccatgctgattctctgtgcttggggaacttgtctttctacaaatataggagtgacttctcaaatgttgtatgtgttcatgcctcattgccagtgggtttaagtttttaaacaatgactactttgaactagatttctgcagtttgatttcgaaacataggacatctgttgtcaaacttggcaatggctaaaaaaataagattttcatgcntcccatagttattttaattgaagattgaaatacagaattactgcaaaagaatatgtgttgtcattaattgtcccattttgtgacattcctgggagctaagctaaacaataaaagttattttatntggtagtaaatcagggaccatatggtatcccaaaataagtctgactgagcagttaaattccaggaaattaaaggctaatgttaatgtaattctcacatttgatcactaggggatgaaatcctagatgtaaatggaataccaataaagggcttgacatttcaagaagccattcatacctttaaggtaacaacattcttattgatctcctttatcctattttcctttcttatttccttctggcttgggtttggtgagttgttttttttttttaaccctttgatataaggacattccaaatgtttcagcccacctttcctcactgttttctcagcaaatccggagtggattatttgttttaacggtacgcacaaagttggtgagccccagcctcacaccctgctcgacacccacacacatgagcagatccgcctccccgaacttcaataccagtgggggagcctcggcgggaggttccgatgaaggcagttcttcatccctgggtcggaagacccctgggcccaaggacaggatcgtcatggaagtaacactcaacaaagagccaagagttggattaggcattggtgcctgctgcttggctctggaaaacagtcctcctggcatctacattcacagccttgctccaggatcagtggccaagatggagagcaacctgagccgcggggatcaaatcctggaagtgaactccgtcaacgtccgccatgctgctttaagcaaagtccacgccatcttgagtaaatgccctccaggacccgttcgccttgtcatcggccggcaccctaatccaaaggtacccccttgaagagtccctctcttgcaaaaaaggactcccttatttctgaatctgaactctcccagtactttgcccacgatgtccctggccccttgtcagacttcatggtggccggttctgaggacgaggatcacccgggaagtggctgcagcacgtcggaggagggcagcctgcctcccagcacctccactcacaaggagcctggaaaacccagagccaacagcctcgtgactcttgggagccatcgggcttctgggctcttccacaagcaggtgacagttgccagacaagccagtctccccggaagcccacaggccctccgaaaccctctcctccgccagaggaaggtaggctgctacgatgccaacgatgccagtgatgaggaagagtttgacagagaaggggactgcatttcactcccaggggccctcccgggtcccatcaggcctctgtcagaggatgacccgaggcgtgtctcaatttcctcttccaagggcatggacgtccacaaccaagaggaacgaccccggaaaacactggtgagcaaggccatctcggcacctcttcttggtagctcagtggacttagaggagagtatcccagagggcatggtggatgctgcgtcctatgcagccaacctcacggactctgcagaggcccccaaggggagccctggaagctggtggaagaaggaactgtcaggatcaagtagcgcacccaaattggaatacacagtccgtacagacacccagagtccgacgaacactgggagccccagttccccccagcagaaaagtgaaggcctgggctccaggcacagaccagtggccagggtaagcccccactgcaagagatccgaggctgaggccaagcccagtggctcacagacagtgaacctgactggcagagccaatgatccatgcgatctggactcgagagtccaggccacttctgtcaaagtgactgtcgctggctttcagccaggtggagctgtggagaagttgtgccaggaatctctgggaaagctgaccactggagatgcttgtgtctctaccagctgtgaactagccagtgctctgtcccatctggatgccagccacctcacagagaacctgcccaaagctgcatcagagctggggcaacaacccatgactggctcttctacacccgacatcacctggagaggctgctgggccttccaccccacggatgtgctgtaacgagtcaaccttcctcccatgattgggcatttcgaacgtttccagagaaaaggttgtcttgaaaggtgacaaccaaaggctgcctcagtgtaacctcgtctccctcagatgaagaccttttaagttacagactttgcaataaagtcaaattgctaacatg

SEQ ID NO: 347559 - DNA, 1981 bp, Homo sapiens
  misc_feature (1256)..(1256): n is a, c, g, or t
gagaagtgtggcgtctcggtccaggatgcaggtccctgattcgggttggacgtggtcatcaaacccagaaattgaaggatcttgggcctgccttgatgttcatttctctcatctataaaattgaaggctggaggaggtgtgaatgagcccagggaaggacacacggccactgctggagggatcctccattcctgtgtcatttgcatgggtcctgctgtgaaatgaacctggcagggacttgttagacacttccttccttccctcattgagcactccagtgccattgttccacagttgttctaattgggtcctagcttcctcctgccaaggcaaacagcatagtctcgagtaggtgtccctaggctcatctgccagcctgaacatgaacacaggcaaagctgatgatggccagggaccccaggggacgtggggccctgtggggtctggcccccaggagcaagacctctgatgatgctggtgtctgggagtgagcaccatgcccatcacccaggacaatgccgtgctgcacctgcccctcctctaccagtggctgcagaacagcctgcaggaaggtggggatgggccggagcagcggctctgccaggcggccatccagaagctgcaggagtacatccagctgaactttgctgtggatgagagtacggtcccacctgatcacagcccccccgaaatggagatctgtactgtgtacctcaccaaggagctgggggacacagagactgtgggcctgagttttgggaacatccctgttttcggggactatggtgaaaagcgcagggggggcaagaagaggaaaacccaccagggtcctgtgctggatgtgggctgcatctgggtgacagagctgaggaagaacagcccagcagggaagagtgggaaggtccgactgcgggatgagatcctctcactgaatgggcagctgatggttggagttgatgtcagtggggccagttacctggctgagcagtgctggaatggcggctttatctacctgatcatgctgcgtcgctttaagcacaaagcccactccacttataatggcaacagtagcaacagctctgaaccaggagaaacacctaccttggagctgggtgaccgaactgcgaaaaaggggaaacgaaccagaaagtttggggtcatctccaggcctcctgccaacaaggcccctgaagaatccaagggcagcgctggctgtgaggtgtccagtgaccccagcactgagctggagaacggcnctgaccctgaacttggaaacggccatgtctttcagctagaaaatggcccagattctctcaaggaggtggctggaccccatctagagaggtcagaagtggacagagggacagagcatagaattccaaagacagatgctcctctgaccacaagcaatgacaaacgccgcttctcaaaaggtgggaagacggacttccaatcgagtgactgcctggcacggcaggaggaagttggccgaatatggaagatggagctgctcaaagaatcggatgggctgggaattcaggttagtggaggccgaggatcaaagcgctcacctcacgctatcgttgtcactcaagtgaaggaaggaggtgccgctcacagggatggcaggctgtccttaggagatgagctgctggtaatcaatggtcatttactggtcgggctctcccacgaggaagcagtggccattcttcgctccgccacgggaatggtgcagcttgtggtggccagcaaggaaaactccgcagaggacctcctcaggttaacatctaagagcttgccagatctgaccagctcggtagaagatgtgtcctcctggactgataacgaagaccaggaggcagacggggaagaggacgaaggaaccagctcttctgtccagagagcaatgcctgggacagatgaaccccaagatgtgtgcggtgctgaggaatccaaggggaacttggaaagtcccaaacag

SEQ ID NO: 347560 - DNA, 426 bp, Homo sapiens
tattaaacctaaatttttagggacatatggctacagagagagctttttttttttgtacaaggaatataaggagcagagaggggagtgcagtggcctcaagaaggtaaagcacatgttaggaaatatggtcagttctaattatgtggccatatatcaaaatttctaatatgatggagttgctgaaccaggacacaggctgtcagaggtatttcattagcagtcaatttggctgagatctgtatagtcaccagacatcaaaccatcacctaccatcagcgaagtcatgtgttcagacacactaaattattacaatatttcttgttactgaatggtgtgtatttcttttctctttcccctaggattcttttttcttccttcttttcttctagtgtaagtagagaataaggaaagctcttgttgacttgg

SEQ ID NO: 347561 - DNA, 1135 bp, Homo sapiens
ctactagggtcaaataataattttaacacaaggcagataaaagcaataaaacctgggaacataaacatcggggttgggtgacttttcccaaccaaaattaagatttatagtttaaacttagaactaacatagaaaaccagtattattttcattcatattggatatcttttggctgagttgtcatttggttgagttgaatttggagttaacatggattctccactgtcaaggatataaccactgtgattctgtttcttctacccacgagtacaggggtactacccctgtttttttctcaaacaggtcaataccatctaattgctatacagttagattgatatctctgaaagttttttgaacagtagttaataatttctatagttctgccttaatagtttgcctcctaaagtccataaattaatagaaatacaggaatttttattctacaggaaagcccctttcaccaaccactcccattcctcacagttcacattttcaaaccagaaaccaggagatggtaatttttgttttatggaacctttctgcaaggcccattgaaatagtttgtttcattaatacattaaatattacctatagaacataaactccttaacaaattaagtacaatcagaaattaagataaagcatctcttaaattttaaattcaaatttactgtaactttttgtgaatacatatgtggtgcaaagaggcctatttgtaaagcctgttaggtatgaatttaatagccatatgttttaattaatttgaaaactgtcattggcagctggtccagacaggaactggcaaaagtactcattcactaggtagtatctaggggctatttgacagcttccgtttcctattgtgaaagcttttatctgattacatggtgtgtgcatgtggaagggctgagtgctgtgtttactgtcagctgtttgaaattattcagtagaaaccgtagctttcacaaccagaatatttccattcttatttctgtagtggatgaggacagaagcagctaagattaaaattcaaaacatattgaggtagttcatctttaaataatcctgaatgaggtctgtacatttgtgatgtgatctgtcctttttattttgttaatgaactcttcttaga

SEQ ID NO: 347562 - DNA, 459 bp, Homo sapiens
gacgtgctaaaactgttcatattatgactcttcatattagcacaaaactggaaacaacccaggtatccataagtactaaaaatgtggtgtaatcaaacaggggaatagtaactaacagttagaatatgaatcacagcactttcaagcaacttggatgaatttcattagcatcatgtcgagtcaaagaaacaaaataaggcaaactgaagactcagagtgtgcgattgggtaggtcatgaggaggactcttgaatgattgttaatatatatctggactggaacggttacattagttctcaaggtgtaaaaatgtgttaagttggctatttacattataggcacttttggaatgtgttttttctttttttacgagaacgagatttaagtttaaaaaagtaatttcagtgtgctcaatattgttcatctataccattatttaataaatatttaaagctgagt

SEQ ID NO: 347563 - DNA, 583 bp, Homo sapiens
ccagatctctcttaccgggggatgcaccaaagcccagctgttcagtgtcaatggctgccagctcccaactacatcccacacagacgggagccacctcaatgtctgcgagatttcctgtccctccttttcaatcccatcaaggcaccctctaccaatgactgatggatacagggatacaaaagcccagacacctatcttccaagaggaaaaaactctgtggtggtgccatttatgttccagagcaactgcgggatcaagctgagggtggactccagctgaaaccacatgcaacagactgaatgcttgtgccctcccaaaattaatatgttgaagctctaatcccaatgtgatgatggtattagggaggtaattgggtcataaaggtggatcccctgttaatgggattagtgcccttataggaagaggccagagaactagcttgctcccttttctccatgtaaggacacagcaagaaggtggcagtctgcaagccaggaagagagccctcaccagagcctgcctatgctggcactctgatcttgaacttccagcttccaacactgtgagaaataaatgtgtattg

SEQ ID NO: 347564 - DNA, 4397 bp, Homo sapiens
  misc_feature (1)..(1): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 347565 - DNA, 520 bp, Homo sapiens
  misc_feature (20)..(20): n is a, c, g, or t
  misc_feature (56)..(56): n is a, c, g, or t
  misc_feature (63)..(64): n is a, c, g, or t
taggcccgggccaaaaggcnccaagccttaaccaggttccccgtgaagaaatctgncctgttnngcttcctgtcattaaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 347566 - DNA, 4174 bp, Homo sapiens
  misc_feature (1)..(1): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 347567 - DNA, 3704 bp, Homo sapiens
cgtttgattcatgtggctcagctgcggcggtttcacctctgtcctccgatgtggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 347568 - DNA, 4720 bp, Homo sapiens
  misc_feature (1)..(1): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaaggtaagtgctgcatgtagggcatggggtctcctggcactggacaggtgccagggaggggcaaggaggagctgtgcccatcactgtcctgagaggcaccttcctggaactcaactgaggccaggaaagaagaaggggttcagatgctaagaccttgtggcatctgaaatgggggaccttattgaatggccttccaaggatacaggagctctttggcaccacctaaggcagaggatgaagggaggttatggggcctgtcaagtctagggcagggacagaaggggaaccccaccctcctagctgactctgtttctctgggcaagcagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 347569 - DNA, 4043 bp, Homo sapiens
  misc_feature (1)..(1): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 347570 - DNA, 3998 bp, Homo sapiens
  misc_feature (1)..(1): n is a, c, g, or t
  misc_feature (3869)..(3869): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaccgaagcaagctaaaccgcagaagaaaataagctgcaaggacagntcttgcagaagctggactcacgatgacttggcacttaggccttggtcttagaaatccctggattttgaaaacctccaatggaattaccctttagacatccttggggcctgatgggatgtggccctgccc

SEQ ID NO: 347571 - DNA, 2506 bp, Homo sapiens
  misc_feature (1)..(1): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagtgctaacaaatcagaaatatgacaattaatgattaaagactgtgattgccacc

SEQ ID NO: 347572 - DNA, 3254 bp, Homo sapiens
  misc_feature (1)..(1): n is a, c, g, or t
  misc_feature (3208)..(3208): n is a, c, g, or t
  misc_feature (3216)..(3216): n is a, c, g, or t
  misc_feature (3239)..(3239): n is a, c, g, or t
  misc_feature (3244)..(3244): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggaattttaacctgggggaaaaaggctgttggccccaaggagtaccccaaaanttccttgnttcaaaatttccggaaaaatttnagggnccccggccct

SEQ ID NO: 347573 - DNA, 506 bp, Homo sapiens
agactctggatttcccacggagctggctgctgcctgtcatccgagaccatgttcaggaaacgcgacttggttttttcaccacctacttcttgcccctggctaacaccctgaagagcaaaggtaggagagacccttgcctgtgtgtgacctgaggctccccacagtcctggaacctccacagaagggattgggaagggtgctgagtcccacacacccagccttcaagacgtttggcaacatccctctgccgagcaggtggccagccagtgctggagtgcctgtctccctccctgctgctccaaggcgaggccaggtggccctccctgtggcagagcttgccctgtgagacaggagctgcctccacatggagctgccccaactgggccttgttcttcccctttggatcacagagaacagctgtgccccttcttcctcatgcaagcccttgagattgattttgtaaaaatttgtgatatgtttgtttatatgtatatatacttttatat

SEQ ID NO: 347574 - DNA, 469 bp, Homo sapiens
actttctctggtggggggcacagggtggtgtgaccgtggccctgactgtgccgcccccttggcagggcagtggaggagggcctgacgtacaaattccatgcggcctggagctccgtgttgcagctgctgtgtgtcttcttcgaggcgtgtgggagacaggcccaccctgtgatgaggaaggtgagtggggagcggctggggccagggcaggaagtggtgctggctcttggactatgggctcctggagggcacgtgtctctgttatctctgcaccctgctccgcaccccaccctgacagggccatagcaggtgccccatgcagtatcccctggaaggtgactgggccaacaagggaggggcaggaaaaagggtggcagtccccccacctgctcactagtctttgctggagttactggttttgaaacttagggagtctatttgctttcccttatccccaccccttatcttt

SEQ ID NO: 347575 - DNA, 423 bp, Homo sapiens
gggaaggagaaaggggcagtgctcaggggtctcatctcttctagcagaaggatgatattggtctgaggaaggcaattttctggggccggagttggtggccccgcagcctggtgagccaggagggggcagaaggaaagggtaggttttgaggagctcccacagcgctcatgggcctctcttttttggctccaggcgaagatgaagagatggctgacccaatggaagatgtgatcatcaggaatgtgagtagttcctgcagatggggggctagggcttcagacctaagcctgggctccacagcttctcacccccaccacacgtagacattggaactgccctgtttctggaatgctcggtgcatcctcacaggtgtgcatagcaggcggtccagaaggttgtgggtgccaggcaggacagggtgat

SEQ ID NO: 347576 - DNA, 4097 bp, Homo sapiens
  misc_feature (1)..(1): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 347577 - DNA, 3788 bp, Homo sapiens
cccgccgtaccagttgcgtcggcccaacacggtgcgttggcccaacacggtgcgtttgcccaacgttgggccaacgcaccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 347578 - DNA, 1672 bp, Homo sapiens
caggaccgctagttgctacagcgcggggcgatggactcactgcgggcgctaaggttaggcgcgaaccaggaaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaaaggccggccggatccctatgcctacatccccctcaacagaagcaagctcaaccgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgca

SEQ ID NO: 347579 - DNA, 3868 bp, Homo sapiens
  misc_feature (1)..(1): n is a, c, g, or t
  misc_feature (3851)..(3851): n is a, c, g, or t
  misc_feature (3859)..(3860): n is a, c, g, or t
  misc_feature (3863)..(3863): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggcgaagatgaagagatggctgacccaatggaagatgtgatcatcaggaataaaaagcaccagaagctcaagcaccagaaagaggctgaggaggaggagctggagataccccctcagtaccaagctggaggctctggcattcatcgccctgtggccaagaaggctatgcctggggctgaatacaaggccaagaaagcaaaaggtgatgtgaagaagaagccgccncccggccnnccnactgt

SEQ ID NO: 347580 - DNA, 4373 bp, Homo sapiens
  misc_feature (1)..(1): n is a, c, g, or t
nagaagaagaggaagtgaaggctacagggtatccacgtgggttctgagcgtgtttctacgtccctggaagccggtcatttaagctcattcctcgccacggcttagtcaacatgggtcgctcgggaaagttgccctctggtgtctcagctaagttgaagcgctggaagaaaggccacagcagcgacagcaaccccgccatctgccgccaccgtcaggccgcccgcagccgcttcttcagccggccgtcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaagtacagcgcttctgggagtccaactcggctgcccacaaggagatctgtgctgttctggctgctgtcactgaggtgattcgctcccagggagggaaggagacggagactgagtacttcgctgctctgatgacaacaatggaagcagtggagtccccggagtccctggccgccgttgcttacctgctgaaccttgtcctgaagcgtgttcccagccctgtgcttattaagaagttctctgatacctccaaagccttcatggatatcatgtcagctcaggccagcagcggctccacctctgtcctccgatgggtcctttcctgcctggccacccttctgcggaagcaagacctggaggcctggggctaccccgtgacccttcaggtgtaccatgggctgctgagcttcacggtgcatcccaagcccaagatccggaaggctgcccagcatggagtatgctcagtcctcaagggcagtgaattcatgtttgaaaaggcccctgcccatcatcctgctgccatttccactgccaagttctgcatccaggagattgagaagtctggaggctccaaggaggccaccaccacgctgcacatgctgacgctgctgaaggacctgctgccctgcttcccggaaggcctggtgaagagctgcagtgagactctcctcagggtcatgaccttgagccatgtgctggtgacagcctgtgccatgcaggcctttcacagcctcttccacgccaggcctggcctgagcaccctgtcagcagagctcaacgcccagatcatcacggccctgtacgactatgttcccagtgagaatgatttacaacccctgctagcctggcttaaggtcatggagaaagcccacatcaacctggtgaggttgcagtgggacctggggctaggccacctccctcgcttttttggaactgcggtgacctgcctcctttccccacactcgcaagtgctgactgctgctacgcagagcctcaaggagatcctgaaggaatgcgtggctccccacatggctgacattggctccgtgacctcctcggcctcaggccctgcccaatctgttgccaagatgttcagggcagtggaggagggcctgacgtacaaattccatgcggcctggagctccgtgttgcagctgctgtgtgtcttcttcgaggcgtgtgggagacaggcccaccctgtgatgaggaagtgcctccagtccctgtgtgacctgcgcctctcccctcatttcccccacacggcggctcttgaccaggcagtgggggctgcggtgaccagtatgggacctgaggtggtgctgcaggctgtgcctttggaaattgatggctctgaggagactctggatttcccacggagctggctgctgcctgtcatccgagaccatgttcaggaaacgcgacttggttttttcaccacctacttcttgcccctggctaacaccctgaagagcaaagccatggacctggctcaggcaggcagcacagtggaatctaagatctacgacacactccagtggcagatgtggacactcctgcctgggttctgcacaaggcctacagatgtggccatctccttcaaagggctggcacggacgctgggcatggccatcagcgagcgtccagacctgagggtcaccgtgtgccaggccctgcgcaccctcatcaccaagggctgccaggcagaggctgaccgtgctgaagtgagtcgctttgccaagaactttctgccgatcctcttcaacctgtatgggcagcccgtggcagccggggacactccagcccctcgccgggctgtgctggaaaccatcagaacttacctcaccatcactgacactcagttggtgaacagtctcctggaaaaagccagtgagaaggtgctcgaccctgccagctctgactttaccagattgtctgtcctggacctggtcgtggccttggctccgtgtgctgacgaagctgccatcagtaagctatactccaccatccggccctacctagagagcaaggcccacggggtgcagaagaaggcctaccgagtgctggaggaggtgtgtgccagtcctcagggccccggggccctcttcgtgcagagccacctggaggacctgaagaagacactgctggactcgctgcggagcacctcctcacccgccaagaggccccgtttgaagtgcctcctacacatcgtgaggaagctctcagctgaacacaaggagttcatcactgccctcatcccagaggtgatcctgtgcaccaaggaggtgtcggtgggcgcacggaagaacgcttttgcactgctcgtggagatgggccatgctttcctaaggtttggctcgaaccaggaagaggccctgcagtgctacctcgtcctgatctaccctggcctggtgggcgcggtgaccatggtcagctgcagcatcctggccctgacccacctccttttcgagtttaaaggtctgatggggaccagtacagtggagcagctgctggagaatgtgtgcctgcttctggcctcccgcacccgtgacgtggtcaagtctgcactgggcttcatcaaggtggcagtgactgtcatggacgtggcgcacctggccaaacatgtgcagctggtgatggaagccattgggaagctttcagatgacatgcggcggcacttccgcatgaagcttcggaacctgttcaccaagttcatccgcaagtttggatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctggccacgcagccagggccaggccggggcaggaagaaggaccacggcttcaaggtgagcgccgatggccggctgatcataagggaggaggcagacggcaacaagatggaggaagaggaaggtgccaaaggtgggcccaacgcgcttgtccattcattcaccgtgttcacttattccttcggtgatcacttgctgaggaagcgtggctaaaaacagaccagagaaactcttctctcggcagcttcctcaaactttttgagtttctcaaactttttttgagaaacattaagaaatctttttatgttgtaaccgagccatttatacaatacatatttaacttaaaggaaactatcggaaatggtacttccccttactgtgtgtgatacgctgttagtctcttctgtttttctcctcctcctccccctcctcttcctttctccttttcttccttcctctttttttttttttttaatgcaaacttggctaaggccctgaagatgatttagaggcagaaagagccagaggctgaaaccctcccaacttcccaatcccaatgtctcacattgcccgggagtccctccggtgtggcatctcggagctctctttagtctttcctggcccctctccacatatccagccattagctaagaaacacttaggtcttcgccaggcgtggtggctcacgcctgtaatcctagcactttgggaggccaaggcgcgcagatcaggaggtcaggagatcaagaccattctggctaacacggttaaaacccatctctactgaaaacacaaaaaattagctgggcgtggtcgcgggcgcctgtagtcccagctactcgggaggctgaggcaggagaatggcgtggacccaggagg

SEQ ID NO: 347581 - DNA, 314 bp, Homo sapiens
tggctgtgttcagaattcagcctctcgggttggagatttggcctgggctggtttgtttcccaggggttgttctgttctcttgaccaaaaggaggcttggaccttatcttgtgcctctggctctcaggaaggagtgacctgacagtcgatgctgtgaagttacataatgagctgcagtcagggtccttgcgcttgggcaaaagcgaagccccggagacgcccatggaagaagaggcggagctggttctcaccgagaagtcctcgggtaccttcctgagtggcctttccgactgcacaaacgtcaccttcagcaaa

SEQ ID NO: 347582 - DNA, 511 bp, Homo sapiens
gctgctcttcagggaccctctggggtgaccatctctgttctttcccacagtgttcccagccctgtgcttattaagaagttctctgatacctccaaagccttcatggatatcatgtcagctcaggccagcagcggctccacctctgtcctccgatgggttagtgtctggggtttagtttctcatctggcgactcccagagcctgtctgatttggtgatgcttagatgttccctgagaggggtttaggcaccctggggacctcagacagatgcgattttctggagtcagtgagaacctgggctcttttccctcctggccgaggctggtggcactgagggactctgactttcttccaggtcctttcctgcctggccacccttctgcggaagcaagacctggaggcctggggctaccccgtgacccttcaggtgtaccatgggctgctgagcttcacggtgcatcccaagcccaaggtgagactactagctccctagaaaatggggcaaggggac

SEQ ID NO: 347583 - DNA, 583 bp, Homo sapiens
ggctggagtgcagtggcttgatcgtagctcactgcagcttccaactcctggactgaagtgatgctgtcacttcagcctccccagtagctggaagtacaggtgcacactagcatgtctggctaatttgtaaaaatttttctagatatagggtctcactatattgcccaggattgaactcctggtctcaaggactcctcccaccttgcccttccaaagcactaggattatgggcatgagccgttgtgcctggctgggggtgaatattttgtgaaatacattgctatgtaatgatacagctttgccctctatatgaaacttgcaaatatgaactgattatgttttgagagagctgccaaaaatcatggctgttgttttagaagtgttgtcaagccattctctgggataatcttgagcagggctcttgtctgctttgattagagtgaggctgtgttatctgcctcttgaaggttctctgtcctttgcaggggagggctaggggatgagatatgccattttcttttcttttcttttcttttcttttctttgagacagagtgttgctctgttgccctggctggagtgca

SEQ ID NO: 347584 - DNA, 450 bp, Homo sapiens
ttttgggaagctactctccttttggtgatgggctgtccagtgcccgttcttccagggatttttttccaggggtgttaaatgctgataagagacaaggaatattgctgctggactgagctgggtgcagttactatctctagaagcatccatctgacttcctgttttgctggagtaggttttttggggtgggctacaattctagtaatggtagatagtttagtttgcagctgtactcaagttacttttcttttctgatttttttttcttggtatcaaaaaatcaggaaagtaaatgcccacttaatggttgggcatcttgtgctctcagccctagttcagtctccctgagggaacagtctgtacccaggtgtggcagtatccataaattgtgtactcctgctccatattgtccttgtgtgctctttttgttggctgtgtaaatcatgtgttg

SEQ ID NO: 347585 - DNA, 761 bp, Homo sapiens
gatctctaaattttgttgttgttgttttgttttgttttgtttttttgagacagggtctcgctctgtcacctaggctggagtacagtggcacaatctcggctcactgcaacctctgcctcctgggttaaagcgattctcctacctcagcttcccgagtagctgggattaatttttgttttttcagtagagatggggtttcaccagttggccaggctgctcttgaactcctgacctcaagtgatccacctgcctcagcctcccaaagtgctggtattacaggcgtgagccatggcacctggccaggatccctattttaatgttaatgctgatcagttgtgcctaaactccaaaagggagggagtacagcaaagcgtgggcaacctcccttccaatcttgaatgggaattcagttttcaggtttcctgtggcccaggagggctcagttcagttggttgcggggcttgggattttatttttggttttcaagactgattattctaaaatcataaaattttagaatgcttccccccacctcagcactttaccaccacaccccagggctcaatataatagtggagcattgtaagcaaacaaactgcaagagcagacgataaggaaaattagagtatcagaaggagaagagagaacagagcaaaagaaataggtgaagtaattaatagccaagaatcttctaaaagtaatgacacaccaaaccacaggttcgggttgctcagaccacaccatgcaggataaataccaaa

SEQ ID NO: 347586 - DNA, 647 bp, Homo sapiens
agagatgaatgaaatgataggatagaagcctggcggacatctggacagaactatgcaagagccttcctgagaatggaagccacaggagggaaaacggaacttgggaaaggaaagagtaaagtggaatttcaatgacatcatttaaatgcctggatccaaaagtgtctggacattcaatatcaaaatatttgcttctcacatcatatttcagtgatgtgagccaaatgttaccttccaccacccttttaagagtccacttgatttcagtgttccttcacttgcaaccagagttctcactgataagtgtctatatggtggttcattcctccctcagtggtatatgacaatgaaacaagaaggtatggcaggttaaaagtcatagggtaccacaacattacacactgagtcacaaaagcagctcaaagccatggtttgtggggctccacctcttgctctctggaaggcattaatacatggtgggagaaaattataagatctatattgtcacagaacttttcacataattatattgttattttatattcatttgctcctgggcttcatcaaatggagaatttcttatctctgtatcctcaaggttcaacacactacctggcacaagctaggtacataataaatgttcaagt

SEQ ID NO: 347587 - DNA, 426 bp, Homo sapiens
atttttgttgtgagagacagggccttgcagtgttgcctaggctttatttaaaaccattttccctgttaacccagtcttggtacaatggtaataaagcaaaatcaaagttcaccactctagaagaattaggcaagtgactttttctaaaacaggtatagtatcattattaaagtgaggtaacagtttttcttttgacttttttttttttttagacagagttttgctctgtcgcccaggctggagcgcaatggcgtgatcctggctcactgcaactgctgcctcccaggttcaagtgattctctcctgcctcagcctcccaagtggcaggtgcctataatcccagctacttgggaggctgaggcgggagaatcgcttgtccccaagaggcggaggttgcagtgagccaagattgcgccactgcacttc

SEQ ID NO: 347588 - DNA, 665 bp, Homo sapiens
cctttacattcaaatttcctcttattcatgaccacaggctcaccacacacatactccttggtttgttactttaagccacatggagattaagtgccattagtaaagactagtttaggaacagttttaggtgaaataaatggcactttcaaagagaaggtggatttatggagtttgtgtgtacatgcgcgtgcatgctcacgtgtgtgtggggataaatcagtaaggaagaaatcaggtggtgatagttggatgccattagtgactgggacatgttttattttacagtgttatttctcacagtttaaaagaaacattagaatcatctaatctggccccctatattacagctgagggaggcccaaagagatgaagaatcttggctactaggcagcgtaactagaacttggatatacttattacttgtgcatccatggtgttcccccatcatcactctcttctctacctaaccacttaagaagtaaatggaggaattgagataatgcagtgtgaaggatgataaaaataggttaagagtgggtccaatcaggcattaaaaaaaatagttatgaaaggtaaattaggatcagttgcaagagtttggggacctaaaacaagcaaaaattagttgatttattaaaatatccactgtttgctcttagcatcca

SEQ ID NO: 347589 - DNA, 954 bp, Homo sapiens
agaaatattgaaatcaaagagtcgagaaagcaaaatgtaaaggtggaaacctatgcacttaaacccaactcttggcaaggtaaagcatccgcggaaacagcaggctctcgaagtgaggaggctgcagccggcgctagggcgcaggcgcagaagctcagcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggacagagttcatttcaaacaacagttccattgcaccctgtgcaaggctcacccttagaaactcctagatcaagtgctaagcagtgcagtcttgaagttaaagtattagtggcagagcctttactgaccacagcccagatctcagggggcaatctactgaaggtcacgttggaggctgcttactctgtgcctgaatccttcattccaacaggtcctgggcagaactacatggtcggtctgcaagttccatcacttggagagaaggactatcccattttatttaagaatggaactctgaagcttggaggggaaagggaacctgttccccggccca

SEQ ID NO: 347590 - DNA, 690 bp, Homo sapiens
agaaatattgaaatcaaagagtcgagaaagcaaaatgtaaaggtggaaacctatgcacttaaacccaactcttggcaaggtaaagcatccgcggaaacagcaggctctcgaagtgaggaggctgcagccggcgctagggcgcaggcgcagaagctcagcgtctcgctccctgctcccggccccagagggttatcgcgagtcttggaataaacttgctcgtgcgatggccaaaaagaccaaagaaaacagagggacttttcccagttggtgatatggagcaagtgccatcagcaggcagactcgtgcagatcaccgtgacagagggatatgatttgaaaggttttaaaggagatactccagttacctttattcgagcagaattcaatcaagtggttctgggagactctgcaaaaattactgtttctccagaaggaagtgcaaaatacaacttcactagcagttttgagtttaatcctgaaggaggaatcacttcagatgacctcgctcacaaacctgtgttcttaactgtgactgaagttttaccaaaggaaaagaaacagaaagaagagaagaccttaattcttggtcaggctgtggtggaccttcttcccttactggaaggtcagatgtgtgctttgcccaaaagcagaaatggaaaagctcataaaacttagccccagagagatatag

SEQ ID NO: 347591 - DNA, 587 bp, Homo sapiens
ccaggcggcacatacatgatcccagacaccgaagtaacctctgtctcactcctccacttccagcaagggatggaaaacaaactgaatctggctcaagtgaatgctcactggaaggcttactggaaaacttactggaaggatgtgaggacatgttcgggaatctatttgcagaaaacatattcagccctgtccaccacagccagctggctgaagagctcaaaaggcaagaaatcagcaagagagagagatgaagcatgagaaatgagcaaaaaacacccagcacatcataatcttggacagtttagcagtacatgaaaatagatggtcctcgccccaagggactgcagtaaccctgaataaacaggatgtctctcacttttagcagttctttctgtgctagtattggggaaatatatttttggctgcatgcaaaatggtaaaagacatctattaagaaaatgaaaacaatgcttctgttttagacgaagcttttgaaggtttaaggatcacctatttattgacaaaattgtttccgtggcttaaaaataaaatacaaacaaataaaaaagtggcctcgttggcctcat

SEQ ID NO: 347592 - DNA, 410 bp, Homo sapiens
tcagacaacagtgtccatgtgcagggcattcaatcatgcaacctttattgaccgagcaaatcttatgcaccagacaatagagtagatgctagagacatacgataaataaaacatatgtcatttgtattaaaatacataacttaaattctgcctagcacatatctttaaagagtctactgtatgggtgtgtattacacagtattctgtgtaataccatgggagtacatattaataatacagatgtttaatatatagtattaagcccctaaaaggaaacataaattaaacctaatcatttgcaagccaatggcatgagtctaataaatgaaatattataattaattcacatctacgtacctaaggttggagaaagagtcatagagaagacaaaaaaactactatcaattgat

SEQ ID NO: 347593 - DNA, 1501 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347594 - DNA, 1377 bp, Homo sapiens
ggcggctcaggtctcgggggcagaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaataaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaagtttcaaaagcaaatccaggttggcgatgaatatc

SEQ ID NO: 347595 - DNA, 1004 bp, Homo sapiens
  misc_feature (91)..(91): n is a, c, g, or t
  misc_feature (101)..(101): n is a, c, g, or t
  misc_feature (111)..(111): n is a, c, g, or t
  misc_feature (114)..(114): n is a, c, g, or t
  misc_feature (124)..(124): n is a, c, g, or t
  misc_feature (126)..(126): n is a, c, g, or t
  misc_feature (129)..(130): n is a, c, g, or t
  misc_feature (133)..(133): n is a, c, g, or t
  misc_feature (142)..(142): n is a, c, g, or t
  misc_feature (144)..(145): n is a, c, g, or t
  misc_feature (148)..(148): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (159)..(159): n is a, c, g, or t
  misc_feature (168)..(168): n is a, c, g, or t
  misc_feature (173)..(173): n is a, c, g, or t
  misc_feature (191)..(191): n is a, c, g, or t
  misc_feature (969)..(969): n is a, c, g, or t
  misc_feature (972)..(972): n is a, c, g, or t
  misc_feature (983)..(983): n is a, c, g, or t
  misc_feature (991)..(991): n is a, c, g, or t
cccgccaccccccccgtgttttgggcccccttctttccgccgccgttcttgcgggctttcttttcggcgtccctctgcccctccttttccntgcggtactncccggtgttnttnttttccgctngncgnncgntccccctgngnnccnacntntncccncatcgtggngattngccttagggcactgatgnggtaggcagtattccggacgggtggatcagttgatgtgtttctcgagcactggcattggtgtgacgagggacagcacaaaggtaatgtaccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggcccccgaagcctganccncctccgacccnccccgccnccactgccgcttc

SEQ ID NO: 347596 - DNA, 854 bp, Homo sapiens
  misc_feature (62)..(62): n is a, c, g, or t
gctttaagtgtaaaactcaaagcgtttatgcaaaaaagaaacactaggagcaaacggagcancttgtaacgatttacagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgtttagcctacaagggacagatttatagtgttcttcagcacatgtctaaaggctacaataacttggttattacgaaatgtattaaaccaacagcctcacgtatagaccccttacctttcctaatcgattcaattattattttattctcaataggcaatattcttttatatgctcataaatatataaaacaatttgtcaaggtcaattgattttcactttaaagcgtccgttgttttcttctataaacgatccttgcatatcgctgttcgtcgaccaccactgcgtttgattcatctgtttattgtcgcattcattaatacggtagtcttgataccgtcgagtttttttgcttttccatctcacatattatatacacaatttgttttagcggttagaatgcgcgtcgaccattgtatccagcgaat

SEQ ID NO: 347597 - DNA, 266 bp, Homo sapiens
caagtaataaaaatcagaccctttcttaatccagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtagacattggacatatatttttattcaccatt

SEQ ID NO: 347598 - DNA, 251 bp, Homo sapiens
gactcttaggtaaataattctagaggcttcaagaaaccatggtctttcttcatcaagccactgtcccccatccctccctatagcagagatgaatatttgtttccagaattgctcaccttcctgcttccctgcagggcctgggtcaatcccagggtgtatgttcccaaccgcccttgatgacctctctgatgaaagacagcaaagctgtctttctagaccatgacgagtgccagcaaagatcctgtagagta

SEQ ID NO: 347599 - DNA, 1559 bp, Homo sapiens
  misc_feature (1507)..(1507): n is a, c, g, or t
  misc_feature (1520)..(1520): n is a, c, g, or t
  misc_feature (1525)..(1525): n is a, c, g, or t
  misc_feature (1528)..(1529): n is a, c, g, or t
  misc_feature (1531)..(1531): n is a, c, g, or t
  misc_feature (1535)..(1535): n is a, c, g, or t
  misc_feature (1538)..(1538): n is a, c, g, or t
  misc_feature (1540)..(1540): n is a, c, g, or t
  misc_feature (1544)..(1544): n is a, c, g, or t
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatcttaaaaaanaacacacaaaacncaaanaannanaacnaananacanacacaacacacaaca

SEQ ID NO: 347600 - DNA, 1418 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaaagcgaaccagcttaaaaaaaaa

SEQ ID NO: 347601 - DNA, 1607 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaactaatacaaaatttgtggggggctgggccaaaaagtttctaaccctccgtggggggcgggcccttgtgcttgacatgcgcaaaggtgcaaaaaacgcggaaaagtggggggtctccccaaaaaaagggggggggaacaggtgcgcgaaaaacccgggtggcgcgggcccgggggccaccgaggccagtgcaccacaccgcccgcgccggcgcgacacacacagcgagacagaacgacaaaacaggcagagaaacaaaccaccgacgaaacaaagacaacaacaaaaaaaagagacacacaaacgaagaagaaacaaaaccaaaaaaagac

SEQ ID NO: 347602 - DNA, 1446 bp, Homo sapiens
  misc_feature (1)..(1): n is a, c, g, or t
  misc_feature (61)..(61): n is a, c, g, or t
ngccacccccccccccccaccacgacccaaaaaccttacggctaggtacgaggctgggtgntgggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347603 - DNA, 1275 bp, Homo sapiens
  misc_feature (7)..(7): n is a, c, g, or t
cggtccnttcggcgccgagcacaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347604 - DNA, 1281 bp, Homo sapiens
ggcggctcaggtctcgggggcagaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347605 - DNA, 1144 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcaccttctgtttggcagagttgggccccagaaaggagaagcaggagacaaacagctgcatccaccctgaaaaccagattatgttactaatgggggaagac

SEQ ID NO: 347606 - DNA, 1368 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaataaaaaaggggaaaaaaaattgttgtggggccggccatcggggccttgaggagagaaggtttcaaagagcccatcccggtggggtcgcggggggcccaagggaaacgtgcacagtgggaccattgggcacaaacagcgtgggctcataagggggagactcgtgggcaagggacaaacggggtcggggttttcctcaacaaataaaaaaccgcgcgggcgggcaacccccgagcggtcctggaccaaatccaaagagggagcgtcaggagggccaatacgggacctatccaacggggggccaacggagggtcgataacaaattagcgcgccgggg

SEQ ID NO: 347607 - DNA, 3389 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtaagaccattggaacataatattttttactcaactattacaactttggtaccttgattagaaaagtcttctaagaaggaagttctctgtcactcttaacagcagttacttgtgctagcttatttcatcacctcacctattttttcagacagtctcattctgttgcccaggctggagtgcagtggtacagtcatagctcactgcagcctcctccaaatcttgggctcaagcaatcctcccgctttagcctctccggtagctgggaactacaggcacatgccaccatacccaattaatttttttaatattttgtagaaacagagtctcactgtctgctgcccatactgccaaaacagagtaaggaggtctcaaactcctagccttgagcaatctacccacctcagcctccgcctcccagagagttgggatcacaggcatgagccaccatacccagcaccttttttttttttaatctccaaattggcgggatgaatgtgtcacagaaataaaagccaagataacactgtaggcttttggcaaaatcaaggtattaaaagaaagaaacaaacagatctagaacagaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctagcctaggcgacagagcaagattcagtctcgagaaaaaaaaaaaaagaccgtagagtctctcctcctcttttttaatgggtttatctaggcacgtttggaaaactcagcaagttatactagatttttacttctcttcatcctcagtatattctgttcatcatgttagaagccttacttaaagacagactttaccttagctatagttttatttgctcttatttggcttcctaaaactagcaaacctcagctctaaatcttttcttttttaatctaaccttgtaatctgtgtgcttatttggttttcaagtacccaaaatagaatgatgattgatattatttaatactggagtgcctctccagtattaaataaaatgtgctaagcattatctagagcaaagatttagcccatcctcccgaagagcccatgctcaacaaaaaacacagacctcagccgggcgcggtggcttatgcctgtaatcccagcactatcggaggccagggcgggcggatcacctgcattcaggagttcaagaccagcatgaccaacatggagaaaccccgtctctgctaaaagtacaaaattagccaggcctggtggcgcatgcctgtaatcccagctgcttgggaggctgaggcaggagaatcgcttgaacctgggaggcggatgttgtggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347608 - DNA, 3247 bp, Homo sapiens
  misc_feature (34)..(34): n is a, c, g, or t
ccggtacgggcaagattctgtccctcttcaccgntggtcagatccaagcaagaaaactttattagattattaagatacgatcctaactattgtttgacctgatagaggctggaaattttgtctccacattgtttgagtggctccttaccactgaggtcctaaaattttttttttttttcctgatagtttcgctcttgttgcccaaacgggagtgcagtggtgcgatcttggctcaccgcaacctccgcctttcctgggttcaagtgattctcctgcctaagcctcccggaagccagcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtaagaccattggaacataatattttttactcaactattacaactttggtaccttgattagaaaagtcttctaagaaggaagttctctgtcactcttaacagcagttacttgtgctagcttatttcatcacctcacctattttttcagacagtctcattctgttgcccaggctggagtgcagtggtacagtcatagctcactgcagcctcctccaaatcttgggctcaagcaatcctcccgctttagcctctccggtagctgggaactacaggcacatgccaccatacccaattaatttttttaatattttgtagaaacagagtctcactgtctgctgcccatactgccaaaacagagtaaggaggtctcaaactcctagccttgagcaatctacccacctcagcctccgcctcccagagagttgggatcacaggcatgagccaccatacccagcaccttttttttttttaatctccaaattggcgggatgaatgtgtcacagaaataaaagccaagataacactgtaggcttttggcaaaatcaaggtattaaaagaaagaaacaaacagatctagaacagaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctagcctaggcgacagagcaagattcagtctcgagaaaaaaaaaaaaagaccgtagagtctctcctcctcttttttaatgggtttatctaggcacgtttggaaaactcagcaagttatactagatttttacttctcttcatcctcagtatattctgttcatcatgttagaagccttacttaaagacagactttaccttagctatagttttatttgctcttatttggcttcctaaaactagcaaacctcagctctaaatcttttcttttttaatctaaccttgtaatctgtgtgcttatttggttttcaagtacccaaaatagaatgatgattgatattatttaatactggagtgcctctccagtattaaataaaatgtgctaagcattatctagagcaaagatttagcccatcctcccgaagagcccatgctcaacaaaaaacacagacctcagccgggcgcggtggcttatgcctgtaatcccagcactatcggaggccagggcgggcggatcacctgcattcaggagttcaagaccagcatgaccaacatggagaaaccccgtctctgctaaaagtacaaaattagccaggcctggtggcgcatgcctgtaatcccagctgcttgggaggctgaggcaggagaatcgcttgaacctgggaggcggatgttgtggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347609 - DNA, 1413 bp, Homo sapiens
gggacgacataggctaggtacagctggtgtgagtcaccgcgactgtcggtgaagcggcagtggcggcggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347610 - DNA, 1356 bp, Homo sapiens
tcggggaggagtagcttacggctaggtacgaggcctgggtgttacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347611 - DNA, 1271 bp, Homo sapiens
taggctaggtacgaggccggtgttaatcggccgagggtacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347612 - DNA, 2015 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccagtacccaaaatagaatgatgattgatattatttaatactggagtgcctctccagtattaaataaaatgtgctaagcattatctagagcaaagatttagcccatcctcccgaagagcccatgctcaacaaaaaacacagacctcagccgggcgcggtggcttatgcctgtaatcccagcactatcggaggccagggcgggcggatcacctgcattcaggagttcaagaccagcatgaccaacatggagaaaccccgtctctgctaaaagtacaaaattagccaggcctggtggcgcatgcctgtaatcccagctgcttgggaggctgaggcaggagaatcgcttgaacctgggaggcggatgttgtggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347613 - DNA, 1647 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347614 - DNA, 1029 bp, Homo sapiens
atagctgttcctagaggtaccccgtgctgcagctatggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347615 - DNA, 1835 bp, Homo sapiens
  misc_feature (957)..(957): n is a, c, g, or t
caaggaatcttaacttaaggcgacttaaggtgattacggagagtgtcactcagtaggatatgggtgcggttagcccataggagtaacgttttgccgataagtgtataaatagctttagagacttatgtgtagtcaggtagtccggacgtgtgatcagttaatggtgtgtcgagcactggcattggtgtgacgagggacagcacaaaggtaatgtaccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggccccaggggaaggagaaacaagggccggtgagggtgggtaagggaggcaaggacggagggagaggccntgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347616 - DNA, 1727 bp, Homo sapiens
  misc_feature (1)..(1): n is a, c, g, or t
  misc_feature (50)..(50): n is a, c, g, or t
  misc_feature (54)..(54): n is a, c, g, or t
  misc_feature (849)..(849): n is a, c, g, or t
ngtggaaaggccgagccactgagggaggcaggagccggacggtggacagntganggtttttcgagcactggcattggtgtgacgagggacagcacaaaggtaatgtaccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggccccaggggaaggagaaacaagggccggtgagggtgggtaagggaggcaaggacggagggagaggccntgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347617 - DNA, 1386 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347618 - DNA, 1640 bp, Homo sapiens
  misc_feature (762)..(762): n is a, c, g, or t
ggaaagcactggattctctttccaccatctgtcagctctcagtatctggagagtaggaggagtggctgatttctgccctatcatctacttcctggcttaagacattttatgagaaaaacattttcacgcaatacagctgaaagtttgaccaagccatatttctttcagtaagtgccatggtggtgtagcagccatatccaggcttcaggaccaaattctacactcacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggccccaggggaaggagaaacaagggccggtgagggtgggtaagggaggcaaggacggagggagaggccntgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347619 - DNA, 907 bp, Homo sapiens
gcttatcctcatggattttgttcctctcaggtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347620 - DNA, 975 bp, Homo sapiens
  misc_feature (951)..(951): n is a, c, g, or t
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaagcctantaccacagcacggtgcatgacaca

SEQ ID NO: 347621 - DNA, 850 bp, Homo sapiens
cgtgggtgacttaccaggatccttaggaaattcgctcgtcgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347622 - DNA, 1188 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacatgcaccactcacgtgtgacctactgttaacctcagaataatccatgaagtaggagctatacgctcattcgctttacaggggaggaaactgagggctggaatgattaaacagtttgtcccaacttccacccactggaaatgattaagccgggaatagaacagagctgtgaactctgctgggcacgggattggcttctcaggacctgtctaagtttgaccattggtctgtcttccatatcagattcctttcaggctacacacaacttacctggtctctattttca

SEQ ID NO: 347623 - DNA, 829 bp, Homo sapiens
taaaactatttattaatttaaaatatccacacaaaaaccacgacgtcagagtaacaagaggacacttaccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347624 - DNA, 833 bp, Homo sapiens
  misc_feature (38)..(39): n is a, c, g, or t
  misc_feature (41)..(42): n is a, c, g, or t
gggcggccagccctggacagcagagttggttttttaanngnngcttgggtggataaaaccagtttttcaggaccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347625 - DNA, 839 bp, Homo sapiens
agcgaatgtcggagcctccggttaccccccgttggttgtgtttcatgccagcgagtgtcagaagaaaggaccgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347626 - DNA, 1110 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacatccgggggaagaaggtttcatccgtaattttggataaaaagaggaaggggttggacctgtaggtggacctggtctgggaatctctatttatgttggcgcctcaggttaggatcccctgg

SEQ ID NO: 347627 - DNA, 751 bp, Homo sapiens
caagaaggtacttaggaaaagataccccaccccatgttcccagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347628 - DNA, 706 bp, Homo sapiens
agacggtattaacaaacatcgagtcactttgcctggacaggaggaacccgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347629 - DNA, 852 bp, Homo sapiens
  misc_feature (1)..(1): n is a, c, g, or t
  misc_feature (50)..(50): n is a, c, g, or t
  misc_feature (54)..(54): n is a, c, g, or t
ngtggaaaggccgagccactgagggaggcaggagccggacggtggacagntganggtttttcgagcactggcattggtgtgacgagggacagcacaaaggtaatgtaccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggcccccgaagcctgaacccgcctgccgagccgccgcccgctaccttaggtagcgaagcttcgctaccttagg

SEQ ID NO: 347630 - DNA, 971 bp, Homo sapiens
caaggaatcttaacttaaggcgacttaaggtgattacggagagtgtcactcagtaggatatgggtgcggttagcccataggagtaacgttttgccgataagtgtataaatagctttagagacttatgtgtagtcaggtagtccggacgtgtgatcagttaatggtgtgtcgagcactggcattggtgtgacgagggacagcacaaaggtaatgtaccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggcccccgaagcctgaacgcctggcccttgtcaccgtaggtcctagcacggcccggctcagccaggcacaatctaggcacggca

SEQ ID NO: 347631 - DNA, 955 bp, Homo sapiens
caaggaatcttaacttaaggcgacttaaggtgattacggagagtgtcactcagtaggatatgggtgcggttagcccataggagtaacgttttgccgataagtgtataaatagctttagagacttatgtgtagtcaggtagtccggacgtgtgatcagttaatggtgtgtcgagcactggcattggtgtgacgagggacagcacaaaggtaatgtaccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggcccccgaagccatgaacccagcctccgaccgccgccgcctaccccagcctcgtacctatgcagtat

SEQ ID NO: 347632 - DNA, 1052 bp, Homo sapiens
  misc_feature (957)..(957): n is a, c, g, or t
caaggaatcttaacttaaggcgacttaaggtgattacggagagtgtcactcagtaggatatgggtgcggttagcccataggagtaacgttttgccgataagtgtataaatagctttagagacttatgtgtagtcaggtagtccggacgtgtgatcagttaatggtgtgtcgagcactggcattggtgtgacgagggacagcacaaaggtaatgtaccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggccccaggggaaggagaaacaagggccggtgagggtgggtaagggaggcaaggacggagggagaggccntgtctgccccctgagtggggctgggtggggtaggaggttaggggagaaggggagaggggaccggggtggagtgaagggtaagacgaacgcccgct

SEQ ID NO: 347633 - DNA, 786 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgaggtaagatccacatcattttccttgggactcttgtttcctcacctttcattggcagtttgccattcatggaagatccatggcactaaatcacccccacatgactacttgctcacctaactaggggctcttgacttgattcctataatgaattgtgtttcctagaaaaggttttgactcttgcttgcttgctttaaaacaatggaaacaaaaatagctttagttctccaaaaacatagcaaagaatacttttccttgatcagtacaaaaatagctgttgcaagaattaggttctgttctatttttgtaatattatcaaggcagatagataacttctagcttgtttaaattttatagtctcaggttctcattctggaggcttaggcacaaatagctgtcttttgaaatttttaattaaagctctttaaagctaccgtctttaaatatct

SEQ ID NO: 347634 - DNA, 2041 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtaagaccattggaacataatattttttactcaactattacaactttggtaccttgattagaaaagtcttctaagaaggaagttctctgtcactcttaacagcagttacttgtgctagcttatttcatcacctcacctattttttcagacagtctcattctgttgcccaggctggagtgcagtggtacagtcatagctcactgcagcctcctccaaatcttgggctcaagcaatcctcccgctttagcctctccggtagctgggaactacaggcacatgccaccatacccaattaatttttttaatattttgtagaaacagagtctcactgtctgctgcccatactgccaaaacagagtaaggaggtctcaaactcctagccttgagcaatctacccacctcagcctccgcctcccagagagttgggatcacaggcatgagccaccatacccagcaccttttttttttttaatctccaaattggcgggatgaatgtgtcacagaaataaaagccaagataacactgtaggcttttggcaaaatcaaggtattaaaagaaagaaacaaacagatctagaacagaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctgtcccaggcataaaaagatactcatctcagttttgtgacttgtttgatgactaaatccacttcccctctgtcttatttcccatccagcaaatgaaagttaggaagaatgccaacttagtaagagcttggcaagtgcagtactttaataataatgtaattatcatggcctttggattaacgaatttggttttgtttcgtttttattttattattaaagagggtgtacgggagtttcttggtaaatccagaatcaggtatgtagtcatgtgagcaattatggaatgacatgggaagagaggtgtcctttttatattatgctttttttacccaaaggatttcgtttaaatattattacaaatatttgtgcatgagcccattcctaatttcaactccctccataaaaatagcttttaaggggctccgctgttgtccaatatgga

SEQ ID NO: 347635 - DNA, 682 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggtatgtagtcatgtgagcaactatggaatgacatgggaagagaggtgtcctttttatattatgctttttttacccaaaggatttcgtttaaatattattacaaatatttctgcatgagcccattcctaatttcaactccgtccataaaaatagcttttaaggggctttgctttgtccaatatggaacacagtagaggtacaaaattgatgtgtgacatttttaacatttacttgatggggccaca

SEQ ID NO: 347636 - DNA, 622 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtagacattggacatatatttttattcaccatt

SEQ ID NO: 347637 - DNA, 759 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagcccccccctcttttttttttttttttttttttttttttttttttttgacatctaaaagcatttattttatgcaaaaaacttaaatatgattatggtgtcacataaagtgcacacattacctatgctgaacaatgccaagaaacataatatattgatgcaacagttttctaaaataaacataaaaatgagcccagaccatcagacaaaagcaaaacacttatttccaaatagcacaatgctgaaaattgatagcaatcctaaaacacctccaactttccttaaaagctgccaaagtccaactattttttaaaaattgattttttttacattaataaaaatctggtgacaaacattataaaaccaaatgctggacagtctttactcctttaaaattccaaatattccaacataatcacagg

SEQ ID NO: 347638 - DNA, 340 bp, Homo sapiens
  misc_feature (74)..(74): n is a, c, g, or t
  misc_feature (288)..(288): n is a, c, g, or t
  misc_feature (301)..(301): n is a, c, g, or t
  misc_feature (306)..(306): n is a, c, g, or t
  misc_feature (309)..(310): n is a, c, g, or t
  misc_feature (312)..(312): n is a, c, g, or t
  misc_feature (316)..(316): n is a, c, g, or t
  misc_feature (319)..(319): n is a, c, g, or t
  misc_feature (321)..(321): n is a, c, g, or t
  misc_feature (325)..(325): n is a, c, g, or t
ctcccctgccccagcgttgtaccccaggaattaaaaaaaaaaataataaagaattccacttgatcaacttaatnccttttctttatcttccctccctcacttcccttttctccaccctcttttccaagctgtccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatcttaaaaaanaacacacaaaacncaaanaannanaacnaananacanacacaacacacaaca

SEQ ID NO: 347639 - DNA, 1221 bp, Homo sapiens
  misc_feature (372)..(372): n is a, c, g, or t
  misc_feature (388)..(388): n is a, c, g, or t
atgtctgtgtagtcttgttgcgctcgtcgtggtatgactgcgtgttctctctcgctcctatctatgcctgtgtgctgtctagggctcccttctctcccccaagctgtttttttgagcgatgtcgcgctgttgtgcaggtttccactgttcgttgttcctcgggcttcttatgcttgatggctcccttatctctgctgcttccgtccgagtgtcccgctttgtgccagcggttctcgtttgtgtcccgagattcgggggttaaacgttttccccgggatggttccatctctttttccggatttggcttcccgttcagcccctgaggaatcaaacttttctcccgcatacgtgtgtgaatataggccttagccncttgatgtgttatgcnaggtagtcccggaacgttgtgatcaggtttatggttttgtctcgagcactggcattggtgtgacgagggacagcacaaaggtaatgtaccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggcccccgaagcctgaacccgcctgccgagccgccgcccgctaccttaggtagcgaagcttcgctaccttagg

SEQ ID NO: 347640 - DNA, 781 bp, Homo sapiens
  misc_feature (652)..(652): n is a, c, g, or t
  misc_feature (722)..(722): n is a, c, g, or t
  misc_feature (738)..(738): n is a, c, g, or t
  misc_feature (781)..(781): n is a, c, g, or t
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatggtggtcattggaaaggtgttcatgcangaattcaaagagggctcatagccaaccacacatccccacatgttcctcttaagcacaaggaaccctctcntgagctgaaagaacanaccccgttgtggtgacacaattgctacatacctttggctgtcn

SEQ ID NO: 347641 - DNA, 1388 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctctttttccaggcttgagggaggggatcctatagcgtcagctg

SEQ ID NO: 347642 - DNA, 1489 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaacagcagaaaaaaaaaactcgagagcagagtcctcctctctcgaaaaagcagggagctgtcgggcaagatcaaaaagccaggtctgtggattgaccaaggggaaacttatctccaaaatgaggaaactggccatggtgtgccgggcccgggggcccggaaaccaggtgcaccgggaagccgtacacggtgtccaccgggaacatgactggggcaggaccag

SEQ ID NO: 347643 - DNA, 1684 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaaaaaaaaaaaaacttggggggcgcctggcccgaaaagttttaaacccttcggttggcgcccgggcccgggtgattgaacatcggccataacgtgggccaaggagaacccggcggcaaggcacatggcgtgggttttccacccaaaaaaaaaaagccgcggcgggaacccggttcgggccggacaccccagctgcgggccgggggcactgttggccaccaccgcggggccactcgggtccgcaagccccccccgtgcccgcgcggagagaaaagagcgacagcacaaacaacgaaacagacgaacaacgaaagaacgagcacacaaagagaacgaaacacagagaaacgacagagcgagacaagaagacgcacagagacacaggacacagacaacagacagggaaccag

SEQ ID NO: 347644 - DNA, 1447 bp, Homo sapiens
gaggtgagaacataggctagtacgagctggtgtaatcggcagaggcggctgtggtgagcggagtgcgggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347645 - DNA, 1447 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347646 - DNA, 1301 bp, Homo sapiens
  misc_feature (49)..(49): n is a, c, g, or t
tcatagaggatccccgtcgcggtttatcccccacttgatcaacttaatnccttttctttatcttccctccctcacttcccttttctccaccctcttttccaagctgtttcgcttgcaatatattactggtaatgagttgcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347647 - DNA, 1307 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaataaaaaaagggaaaaaaactttgtgggcggcttgggccttggaaaagtttttagaaacaatcggttgggggcgggggcccggtagggctaagggcacatgggccatagcggtcccaaggagaaccgggccatgactagggctgggttttctcacaattaaaaaaaaggccggggggaaaccggagggttttgaaaaattccagagggagttcggaggacataacggggtctatcacgggggttcaagggaactcgatatcaaatttagccggg

SEQ ID NO: 347648 - DNA, 1450 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347649 - DNA, 2919 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtaagaccattggaacataatattttttactcaactattacaactttggtaccttgattagaaaagtcttctaagaaggaagttctctgtcactcttaacagcagttacttgtgctagcttatttcatcacctcacctattttttcagacagtctcattctgttgcccaggctggagtgcagtggtacagtcatagctcactgcagcctcctccaaatcttgggctcaagcaatcctcccgctttagcctctccggtagctgggaactacaggcacatgccaccatacccaattaatttttttaatattttgtagaaacagagtctcactgtctgctgcccatactgccaaaacagagtaaggaggtctcaaactcctagccttgagcaatctacccacctcagcctccgcctcccagagagttgggatcacaggcatgagccaccatacccagcaccttttttttttttaatctccaaattggcgggatgaatgtgtcacagaaataaaagccaagataacactgtaggcttttggcaaaatcaaggtattaaaagaaagaaacaaacagatctagaacagaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctgtcccaggcataaaaagatactcatctcagttttgtgacttgtttgatgactaaatccacttcccctctgtcttatttcccatccagcaaatgaaagttaggaagaatgccaacttagtaagagcttggcaagtgcagtactttaataataatgtaattatcatggcctttggattaacgaatttggttttgtttcgtttttattttattattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347650 - DNA, 1552 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgaggtgaatgaactcagaggaatacaaccaccctttctacaacaagagtcctcgacaagatgatcttggaagacttttgcagctctgaagtgctgttacctggcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347651 - DNA, 1403 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347652 - DNA, 2096 bp, Homo sapiens
  misc_feature (372)..(372): n is a, c, g, or t
  misc_feature (388)..(388): n is a, c, g, or t
  misc_feature (1218)..(1218): n is a, c, g, or t
atgtctgtgtagtcttgttgcgctcgtcgtggtatgactgcgtgttctctctcgctcctatctatgcctgtgtgctgtctagggctcccttctctcccccaagctgtttttttgagcgatgtcgcgctgttgtgcaggtttccactgttcgttgttcctcgggcttcttatgcttgatggctcccttatctctgctgcttccgtccgagtgtcccgctttgtgccagcggttctcgtttgtgtcccgagattcgggggttaaacgttttccccgggatggttccatctctttttccggatttggcttcccgttcagcccctgaggaatcaaacttttctcccgcatacgtgtgtgaatataggccttagccncttgatgtgttatgcnaggtagtcccggaacgttgtgatcaggtttatggttttgtctcgagcactggcattggtgtgacgagggacagcacaaaggtaatgtaccaatgttgtcacccacagcggcgtctgtgtctttcagctccagaggaggttccctgtggctaaagaggacctgtggggctgtgtggctggctctgcgtccttctttgaactcctgcatgaacacctttccaatgaccacatcgtcgtcatccttaaacactgtgctgaagactactgtgactctgtcctttttagactcaacatacatggtctcatcatccctataatggataactgccctgttctctccttccttgccctcttcttggaattggaagtatttttcaaagacagaggcaaaacaatttcgcttcaacatgccagcttgatgcacaatggaatccttggatgccggaagattttcaaggtcatatagcaaagagacattgtatcctgattctggatttaccaagaaactcccgtacaccctctttaataactcatcagcaccatgtgcctgaagttccttgtagaatttcaaagaaatactgaccatcacttttgttttgtctccattaggatttgaaatatgatagaggaccccatcgaaatctgcaaatgttacttctactgcttccggtttgtttccggcggccgcgttctcgaacttgagcgcgagcgtctcctcgatgatgcggttgttcacctccagcaggatcatggcggcggctggccccaggggaaggagaaacaagggccggtgagggtgggtaagggaggcaaggacggagggagaggccntgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347653 - DNA, 3223 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtaagaccattggaacataatattttttactcaactattacaactttggtaccttgattagaaaagtcttctaagaaggaagttctctgtcactcttaacagcagttacttgtgctagcttatttcatcacctcacctattttttcagacagtctcattctgttgcccaggctggagtgcagtggtacagtcatagctcactgcagcctcctccaaatcttgggctcaagcaatcctcccgctttagcctctccggtagctgggaactacaggcacatgccaccatacccaattaatttttttaatattttgtagaaacagagtctcactgtctgctgcccatactgccaaaacagagtaaggaggtctcaaactcctagccttgagcaatctacccacctcagcctccgcctcccagagagttgggatcacaggcatgagccaccatacccagcaccttttttttttttaatctccaaattggcgggatgaatgtgtcacagaaataaaagccaagataacactgtaggcttttggcaaaatcaaggtattaaaagaaagaaacaaacagatctagaacagaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctagcctaggcgacagagcaagattcagtctcgagaaaaaaaaaaaaagaccgtagagtctctcctcctcttttttaatgggtttatctaggcacgtttggaaaactcagcaagttatactagatttttacttctcttcatcctcagtatattctgttcatcatgttagaagccttacttaaagacagactttaccttagctatagttttatttgctcttatttggcttcctaaaactagcaaacctcagctctaaatcttttcttttttaatctaaccttgtaatctgtgtgcttatttggttttcaagtacccaaaatagaatgatgattgatattatttaatactggagtgcctctccagtattaaataaaatgtgctaagcattatctagagcaaagatttagcccatcctcccgaagagcccatgctcaacaaaaaacacagacctcagccgggcgcggtggcttatgcctgtaatcccagcactatcggaggccagggcgggcggatcacctgcattcaggagttcaagaccagcatgaccaacatggagaaaccccgtctctgctaaaagtacaaaattagccaggcctggtggcgcatgcctgtaatcccagctgcttgggaggctgaggcaggagaatcgcttgaacctgggaggcggatgttgtggatacaatgtctctttgctatatgaccttgaaaatcttccggcatccaaggattccattgtgcatcaagctggtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347654 - DNA, 911 bp, Homo sapiens
  misc_feature (31)..(31): n is a, c, g, or t
tatcccgtggcattgcagcgggcatgatganaccatatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttgtgctgttccctcgtcacaccaatgccagtgctcgagacaacaccatcaacctgatccacacgttccgggactacctgcactaccacatcaagtgctctaaggcctatattcacacacgtatgcgggcgaaaacgtctgacttcctcaaggtgctgaaccgcgcacgcccagatgccgagaaaaaagaaatgaaaacaatcacggggaagacgttttcatcccgctaatcttgggaataagaggaggaagcggctggcaactgaaggctggaacacttgctactggataatcgtagcttttaatgttgcgcctcttcaggttcttaagggattctccgttttggttccattttgtacacgtttggaaaataatctgcagaaacgagctgtgcttgcaaagacttcatagttcccaagaattaaaaaaaaaaaagaattccacttgatcaacttaattccttttctttatcttccctccctcacttcccttttctcccaccctcttttccaagctgtttcgctttgcaatatattactggtaatgagttgcaggataatgcagtcataacttgttttctcctaagtatttgagttcaaaactcctgtatctaaagaaatacggttggggtcattaataaagaaaatctttctatctta

SEQ ID NO: 347655 - DNA, 872 bp, Homo sapiens
ggcgccgcggggccgcgcgtccaggcggcgagcggaagtgggtgtgagagcggaagtggccggctagagccgggggctgggcggggaccgggcttgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtatgttgagtctaaaaaggacagagtcacagtagtcttcagcacagtgtttaaggatgacgacgatgtggtcattggaaaggtgttcatgcaggagttcaaagaaggacgcagagccagccacacagccccacaggtcctctttagccacagggaacctcctctggagctgaaagacacagacgccgctgtgggtgacaacattggctacattacctttggtactcaagctcgagttcgtatcatgt

SEQ ID NO: 347656 - DNA, 2335 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggcagtcttctaataggttgtctcaacattcatggccagaggaattgaaaggcaccgtgtcatccttgaatagaacagctatgttatactgctttaaaaaggaggtttaaagtggaaaaactgaacagcctttttaccctgtgattcagtggcatgtctcaaattctgaggcatttagcaggaccccaaagtgagaaccaggtagtaagaccattggaacataatattttttactcaactattacaactttggtaccttgattagaaaagtcttctaagaaggaagttctctgtcactcttaacagcagttacttgtgctagcttatttcatcacctcacctattttttcagacagtctcattctgttgcccaggctggagtgcagtggtacagtcatagctcactgcagcctcctccaaatcttgggctcaagcaatcctcccgctttagcctctccggtagctgggaactacaggcacatgccaccatacccaattaatttttttaatattttgtagaaacagagtctcactgtctgctgcccatactgccaaaacagagtaaggaggtctcaaactcctagccttgagcaatctacccacctcagcctccgcctcccagagagttgggatcacaggcatgagccaccatacccagcaccttttttttttttaatctccaaattggcgggatgaatgtgtcacagaaataaaagccaagataacactgtaggcttttggcaaaatcaaggtattaaaagaaagaaacaaacagatctagaacagaaaaatcatgtccaaagtcttgggcatgcttgtcacagccaacatcctgacatggaaagtttatgtttctgtccctgggcctccttctacctcccactaaatcatagacattgccagattgcagaccctgtcttcatagaagtgtgaaatgtaaaagtgtgtgaaagtagtgtctcaaccaggtgcagtggctcacacctgtaatcccagcactttggggaggccaaggtgagtgaattgcttgagctcagaagttcaggaccagcctgggcagcataatgagatacctgtctctataaaaaatacagaaattagccaggcatggtggcagccacctgtaataccaggtactcaggtggctgaagcacgagaatcgcttgaacccaggaggcagaggttgcagtgagctgagattgcgccactgccctctagcctaggcgacagagcaagattcagtctcgagaaaaaaaaaaaaagaccgtagagtctctcctcctcttttttaatgggtttatctaggcacgtttggaaaactcagcaagttatactagatttttacttctcttcatcctcagtatattctgttcatcatgttagaagccttacttaaagacagactttaccttagctatagttttatttgctcttatttggcttcctaaaactagcaaacctcagctctaaatcttttcttttttaatctaaccttgtaatctgtgtgcttatttggttttcaagtacccaaaatagaatgatgattgatattatttaatactggagtgcctctccagtattaaataaaatgtgctaagcattatctagagcaaagatttagcccatcctcccgaagagcccatgctcaacaaaaaacacagacctcagccgggcgcggtggcttatgcctgtaatcccagcactatcggaggccagggcgggcggatcacctgcattcaggagttcaagaccagcatgaccaacatggagaaaccccgtctctgctaaaagtacaaaattagccaggcctggtggcgcatgcctgtaatcccagctgcttgggaggctgaggcaggagaatcgcttgaacctgggaggcggatgttgtgggtgagccaagatcatgccattgcactccagcctgggcaacaagagcgaaactccatctca

SEQ ID NO: 347657 - DNA, 624 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagttattaaagagggtgtacgggagtttcttggtaaatccagaatcaggatacaatgtctctttgctatatgaccttgaaaatcttccggcatccaaggattccattgtgcatcaagctggcatgttgaagcacagctctcttctcctattttcatcctgcaagcaactcaaaatatttaaaataaagtttacattgtagttattttcaaatctttgcttgataagtattaagaaatattggacttgctgccgtaatttaaagctctgttgatgcgggggggatcc

SEQ ID NO: 347658 - DNA, 693 bp, Homo sapiens
gggacgacataggctaggtacagctggtgtgagtcaccgcgactgtcggtgaagcggcagtggcggcggcggcggcggctcggcaggcgggttcaggcttcgggggccagccgccgccatgatcctgctggaggtgaacaaccgcatcatcgaggagacgctcgcgctcaagttcgagaacgcggccgccggaaacaaaccggaagcagtagaagtaacatttgcagatttcgatggggtcctctatcatatttcaaatcctaatggagacaaaacaaaagtgatggtcagtatttctttgaaattctacaaggaacttcaggcacatggtgctgatgagatacaatgtctctttgctatatgaccttgaaaatcttccggcatccaaggattccattgtgcatcaagctggcatgttgaagcgaaattgttttgcctctgtctttgaaaaatacttccaattccaagaagagggcaaggaaggagagaacagggcagttatccattatagggatgatgagaccatgtgagtgtagaatttggtcctgaagcctggatatggctgctacaccaccatggcacttactgaaagaaatatggcttggtcaaactttcagctgtattgcgtgaaaatgtttttctcataaaatgtcttaagccaggaagtagatgatagggcagaaatcagccact

SEQ ID NO: 347659 - DNA, 2370 bp, Homo sapiens
ctcggagaaggggcgcaggtggccgccatcttggattgcgaactgggtcgctacgcttcacgccagggcggagtggcggcccttctgttacccgccacacacgtcgccgctggggactgggaaatcagggcatcggagagtgccacattaatggatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaatttgaagctgcatgggcattaacaaatatagcatctggaacttttctgcataccaaggtagtgattgaaactggggctgttccgatttttatcaaacttcttaattctgaacatgaagatgttcaggaacaggctgtttgggcacttggtaatattgctggtgacaatgcagaatgcagagattttgttttgaattgtgaaatacttccacctcttttagagttattaacaaattcaaacagactcacaacaacaagaaatgccgtgtgggccctctcaaatttatgtagaggcaaaaaccctcctccaaactttagtaaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgcacaatgattataaagttgtatcacctgcattaagggcagttggtaatattgtgactggtgatgatattcaaacacaggtaattttgaattgttctgcattaccctgtctcttacatttattgagtagcccaaaggagtcaattagaaaagaagcctgctggactgtttctaacatcactgctggaaatagagctcagattcaggctgttatagatgcaaatatttttcctgttttgattgagattcttcagaaagcagagtttcgtaccagaaaagaagcagcttgggctataactaatgcaacatcaggaggtactccagagcaaataaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcaggtaactcctctttgttgccaatgtaagaatgtttgtttttttacatagaacagtaaagagaatttgatgcacttttagaaagcaaaatgaaacaaaaatttccattcagatgcaacctttcattgtagtttgttgttgttttagttttgttgttgtgcctgtatttatatcttctattgtttggatttttgtatctatttgtgaataattgaatatgcaattatttagtaatttaagcttgaaaaggagaattttggtgaagcattacttagtaattctgaattttttcaagcattcttggaaactgcacattagcagtaaacctattgataattgcattttggcagtaagtcttacacatctaatctctactaaatctacctctatcttgaagcagaaataaaaacaaaaaagcttcagaagcatgaaataatgcaaatgctaaattagaatgtgaaaatatttattaccttaaattatacatatcactgtgctgtaggttatactttgcaaaaaattgcaacagaaaacctataaaatttatttataaaacag

SEQ ID NO: 347660 - DNA, 2184 bp, Homo sapiens
ctcggagaaggggcgcaggtggccgccatcttggattgcgaactgggtcgctacgcttcacgccagggcggagtggcggcccttctgttacccgccacacacgtcgccgctggggactgggaaatcagggcatcggagagtgccacattaatggatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaatttgaagctgcatgggcattaacaaatatagcatctggaacttttctgcataccaaggtagtgattgaaactggggctgttccgatttttatcaaacttcttaattctgaacatgaagatgttcaggaacaggctgtttgggcacttggtaatattgctggtgacaatgcagaatgcagagattttgttttgaattgtgaaatacttccacctcttttagagttattaacaaattcaaacagactcacaacaacaagaaatgccgtgtgggccctctcaaatttatgtagaggcaaaaaccctcctccaaactttagtaaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgcacaatgattataaagttgtatcacctgcattaagggcagttggtaatattgtgactggtgatgatattcaaacacaggtaattttgaattgttctgcattaccctgtctcttacatttattgagtagcccaaaggagtcaattagaaaagaagcctgctggactgtttctaacatcactgctggaaatagagctcagattcaggctgttatagatgcaaatatttttcctgttttgattgagattcttcagaaagcagagtttcgtaccagaaaagaagcagcttgggctataactaatgcaacatcaggaggtactccagagcaaataaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcagaaatgacagactttttcattgaatgatgaggacacagcagccatattatgccaagaggaaaaatatcatgatcatattgaaagatcaagcatgagcttccatggtgaagtcttctgtaccaatgcaccagagaatgcctaccatccaaaaaagcagtcagctgatggaaaagaagattattaaacctttgttctgggatttactgttaaaaaacaaacaaaaaacaacaaaaaagcggtgacaggaaacagttaaggaaatgatttaactgaagggaagcaagatttttttaaagcattgttcttaatccccatgactgtccttcagtcacaattccagaataaaagaatctactttgtgtaaaaatgt

SEQ ID NO: 347661 - DNA, 224 bp, Homo sapiens
catttattgagtagcccaaaggagtcaattagaaaagaagcctgctggactgtttctaacatcactgctggaaatagagctcagattcaggtaactacccttcagatctgagagtagaacagcaaggtctaagaagccagtttggacaaaagttaacacttttactaaaaaagattcctttttaaaaagataccgaaaaagtattttaaagaacatgggctttc

SEQ ID NO: 347662 - DNA, 2476 bp, Homo sapiens
ctcggagaaggggcgcaggtggccgccatcttggattgcgaactgggtcgctacgcttcacgccagggcggagtggcggcccttctgttacccgccacacacgtcgccgctggggactgggaaatcagggcatcggagagtgccacattaatgggtctctggaacctggcggtgccgggtgtttctcgtgttttccccagggcgacagcggtcgcgggggcgtggcagccggacctttcccttgcggacgcgaaggcgtgatgccatggctagtccagggaaagataactatagaatgaaaagttataagaataaagccctaaatcctcaagagatgcgtagacgaagagaagaagaaggaatacagcttagaaaacaaaaaagagaagaacagttgttcaaacgcagaaatgtctatttgcccagaaatgatgaatctatgcttgaaagtcctatacaggatccagatattagttccactgtacccattccagaggaagaagttgttactacagatatggttcagatgattttttctaataatgctgatcaacagctaacagcaacacagaaatttagaaagctgctttctaaagaacctaatccaccaatagatcaagttatacagaaaccaggagttgtacagagatttgtgaaatttcttgaaagaaatgaaaattgcactttacaatttgaagctgcatgggcattaacaaatatagcatctggaacttttctgcataccaaggtagtgattgaaactggggctgttccgatttttatcaaacttcttaattctgaacatgaagatgttcaggaacaggctgtttgggcacttggtaatattgctggtgacaatgcagaatgcagagattttgttttgaattgtgaaatacttccacctcttttagagttattaacaaattcaaacagactcacaacaacaagaaatgccgtgtgggccctctcaaatttatgtagaggcaaaaaccctcctccaaactttagtaaggtttcaccttgcttaaatgtcctgtcacgactgttgtttagcagtgacccagatgtgttagcagacgtgtgttgggccctttcttatctctccgatggacccaatgataaaattcaagcagtcattgattctggagtctgtcgaagattggtggaacttttgatgcacaatgattataaagttgtatcacctgcattaagggcagttggtaatattgtgactggtgatgatattcaaacacaggtaattttgaattgttctgcattaccctgtctcttacatttattgagtagcccaaaggagtcaattagaaaagaagcctgctggactgtttctaacatcactgctggaaatagagctcagattcaggctgttatagatgcaaatatttttcctgttttgattgagattcttcagaaagcagagtttcgtaccagaaaagaagcagcttgggctataactaatgcaacatcaggaggtactccagagcaaataaggtatttggtagctttaggctgcattaaaccactttgtgatcttttgactgttatggactccaaaatagtccaagtggctttaaatggacttgaaaatattttacgtcttggagaacaagaatctaagcagaatggaataggcattaatccatactgtgctctcattgaagaagcatatggtctggataaaattgagtttttgcaaagccatgaaaatcaggaaatttaccagaaggcatttgatctgattgaacattactttggtgtagaagaagatgaccccagcattgtacctcaggtggatgaaaaccaacaacagtttatatttcagcagcaggaagcaccaatggatggatttcaactttaacttactggaggaaaaaaaatttatggctaaaaagggtagcttcaggtaactcctctttgttgccaatgtaagaatgtttgtttttttacatagaacagtaaagagaatttgatgcacttttagaaagcaaaatgaaacaaaaatttccattcagatgcaacctttcattgtagtttgttgttgttttagttttgttgttgtgcctgtatttatatcttctattgtttggatttttgtatctatttgtgaataattgaatatgcaattatttagtaatttaagcttgaaaaggagaattttggtgaagcattacttagtaattctgaattttttcaagcattcttggaaactgcacattagcagtaaacctattgataattgcattttggcagtaagtcttacacatctaatctctactaaatctacctctatcttgaagcagaaataaaaacaaaaaagcttcagaagcatgaaataatgcaaatgctaaattagaatgtgaaaatatttattaccttaaattatacatatcactgtgctgtaggttatactttgcaaaaaattgcaacagaaaacctataaaatttatttataaaacag

SEQ ID NO: 347663 - DNA, 838 bp, Homo sapiens
  misc_feature (123)..(123): n is a, c, g, or t
tctcctagcacagtgcctaaaacaccataggtgagcactaaatgtgaggtatgattgttagtagtgacagtaataatattgatataacatgcacaaagctcagctattacagcaggaatttcncagaaggaatcagcaagaaagaagataatattaagaagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 347664 - DNA, 471 bp, Homo sapiens
  misc_feature (1)..(1): n is a, c, g, or t
  misc_feature (9)..(9): n is a, c, g, or t
nattttggnacggaaacccttttttgttgacctgttgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 347665 - DNA, 467 bp, Homo sapiens
tgagatggagtctcgctctgtcgcccaggctggagtgcagtggcgcaatctcagctcattgcaagctctgcctcccgggtttacgccattctcctgcctcagcctcctgagtagctgggaccacaggcgcccaccaccctgcccggctaattttttatattcttagtagagacggtgtttcaccatgttagccaggatggtctcgatctcctgaccatgtgatccgcccacctcagtctcccacagtgctgggattacaggcgtgagccactgcacccggccttaaatagtaatttcaaagcattttttatgctttcagccaacggcagcctttaacagttgagcacatgtatgaagacatcagtcaggatcatgtgaagaaaacagtgaccattgaaaatcaccctcatctgccaccacctcccatggggtcgacgcggccgggaatttaataatagtagtcgacc

SEQ ID NO: 347666 - DNA, 201 bp, Homo sapiens
ccccagacactatcccaaccacccagccccacaattccctcaccacttcacaacggcagcctttaacagttgagcacatgtatgaagacatcagtcaggatcatgtgaagaaaacagtgaccattgaaaatcaccctcatctgccaccacctcccatgtgttcagttcacccatgcaggtctgtatatgtagagataaata

SEQ ID NO: 347667 - DNA, 1659 bp, Homo sapiens
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 347668 - DNA, 1828 bp, Homo sapiens
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagagaaaaaacccacaggaggggtcttcccccgtcgtttgcagatggggaaaacaacacaatgggccccttgggctcagcggggactttggggccgttcccttagtggggttaattaaatcccggttatcacttctagcttggtgttggtggagacggattactacttaagcgg

SEQ ID NO: 347669 - DNA, 3147 bp, Homo sapiens
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatccttccctgtatgtaagattagtggcaaaatggctgttaacgattttttttttgagaaatttagtgtaaccttaatgatacagtagctataacttgttttaacttctcatctgaaaatcctagtagaagtctttcatttatttagaaaatgttatattgtgatagttatgccttgcttagttgattagaacatgtccccatgtgtagcagtagctcacccttgttacagaggtaactactaatttagaataataatatgagtatctttttcttatgtacatttccagtttaacatgttaccaaaaatgtactttcccatcaggtaaaagtaaaattaggttgtgtcaatctgaggtgtctctgaagcaaataattcagcttaaacaaatacgttaattaaaagtaatgtactacgtgaagtgctttagatattcttaaaatatagtacgttcatttttctcaagacagtagcacctttcttgtatcttactatagttttcctactcagttttcttggattgacaaaagtaatacattcaagttaatgcccaagcaaactgttggatcctaaagtacatgtactcatagcatagatttatcaaaaacagtcaaaatcaatgatttacatgccagatagcttgaattagtttgatgctaggttaatacttgacttggtggtggtttcggctactatgtgttagattagatgtggagactaagacgccacgtctaatcagactgtggggcattgctaataaagtgtgtccctaagaagaactttgaactgatttgatattgaaacaaaccaaaaacttccagtccaaaccatatttactcctgaagtcctattatgcctaactggcacatctctgctggatgctaggtagcaacttggaagactgtctatatataattcataatagtaattggtttcccccaatgaaaagtaagctcctaatgtttttaagtgcaatgaacataaaaaaatttcagaatttaattaaagacagtccagtagagctcagtctttggcaaatacatacactaacctagaatcagtctactatacaggatttttatttaatttttttctcttttgctatagtactttattatagtctattctgcctcattttctgacataactctagcaaacttaaaggagtctagtaaatgagtacattttgtactcatttaaacatgtatagctttgtcctttttatgtcaaagtaattgtgcttatatgaacacctactcattaagaagtttcaaattcaataatcgaatgagtggtcaggtagtcttaaagagcctcatgttaaatagacacaaatttgcatagttgaattctttaatagacttaatttaagattttgtggggtttttttgagaaattaatggcttaataaaatggataattacaacatgggcttaaaacatagaactatttacaaatcttattttccttagctaaaaacctttaggtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 347670 - DNA, 1650 bp, Homo sapiens
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 347671 - DNA, 1443 bp, Homo sapiens
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttattttccttgaaatgttgtacaaactgtgcatgggaccggtaccgacc

SEQ ID NO: 347672 - DNA, 1021 bp, Homo sapiens
tcacctcggtccggatctcctttcacttcgtccactgtccaacatggcatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 347673 - DNA, 993 bp, Homo sapiens
  misc_feature (30)..(30): n is a, c, g, or t
gaacggactcgccacgaacgggcccaggcnccgccatctaacgcacaggaaaaggtagtcgtgcaaccactctctctatttttccccgctacactgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 347674 - DNA, 815 bp, Homo sapiens
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagaggtgagtgctgaagatatactgaagtctttttattttacaataatactaaactaggtggcttttctgcttcataagaaaacatcttgaactttaattttgatttgagtaaaattaggttttatgactgtgatttatgggaatttctacttcccatagaagaaaagatgtaacttccc

SEQ ID NO: 347675 - DNA, 580 bp, Homo sapiens
tttttattgcttactggatttcagtgttacctagtgccatcagtttggtattttgccaccttgcacattcagtgatgtttgatttttctttttcctttttttcatattacttttaaatcctgaatagtttgtggcagctggagatcacctagtccaccactgtccaacatggcaatggtaagtaatattgagtaaagaatagaaaattagtaaaatgcatggcttcagaattatagcaatttgcaaaataggttaatggatgaaaattagaatgaccagtttaactttccccccagcagattcttctgttaaacaatgccccttcaaaataaaggaagaacaagtgggtgttatacctatgttatttggctatgttagcacaatatgatggactaatttgagaaaaatgcatttacttcctttactattacttcttttctttatagtgtctaagtctgaccttctggttctttgaataataaatagtttaataaaatttgatcaggtttttggcagggcgcggtggctcacacctgtaatcccagcactttgggaggctgaggcgggcagatcacgaggt

SEQ ID NO: 347676 - DNA, 311 bp, Homo sapiens
tcgcgcaagtctattatcctgctgtatcctcataattccgcccttccaaaccttaataccaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttattttccttgaaatgttgtacaaactgtgcatgggaccggtaccgacc

SEQ ID NO: 347677 - DNA, 2120 bp, Homo sapiens
  misc_feature (1668)..(1668): n is a, c, g, or t
  misc_feature (1671)..(1671): n is a, c, g, or t
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagagaaaaaaaaanaanaaaaaaaaaaaaaaaaaaaaaaaaaaaaaaaaaaaaaaaaaaaaaaaaaaaaaaagggggggggggacttcataaaagtcacccccggaggggggaccaaatttggatggccaacacaccatttctttgagtgaaaagggatggccccccacaaaggaaacggcacataataaacaacgacaacgaggaacagggagggcaggatataaaacaaacgctggtcgtaagtggaggaaaaatcagcacacgggaggcaaaccgtgggaagaaaaccacaccacatccgggatggggggcaccactgagggaaaccaccaccacacgagagatataacagagcgcgggacgaaaatactaaccaggcggcgagctacagttggtgaaacaaacgcggatattgcagccgcacagaaaactggccacggaaagtcaacgtgtcagaacaatag

SEQ ID NO: 347678 - DNA, 1712 bp, Homo sapiens
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagagacacagatgcggccaccttttcttctgatacgttataatcaattctgggcatag

SEQ ID NO: 347679 - DNA, 1651 bp, Homo sapiens
  misc_feature (1446)..(1446): n is a, c, g, or t
  misc_feature (1498)..(1501): n is a, c, g, or t
  misc_feature (1533)..(1533): n is a, c, g, or t
  misc_feature (1540)..(1540): n is a, c, g, or t
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttctggaaattgggacaagctgtcatcccaacaaaaaaagacccncacccaacccgggggaaaggaaaaaaaaatataatatagtttttttttatannnncgggagggggaaaaaaacaaaccgaaaaaggngccgagncaccaaaaccacgaaaaaaaacattttttctaaaaaggacttatatgtttatgcattaaataaaaataaaatcccatcaaagccttacttgtttaataaaataaagtgcaa

SEQ ID NO: 347680 - DNA, 1270 bp, Homo sapiens
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 347681 - DNA, 1597 bp, Homo sapiens
  misc_feature (1392)..(1392): n is a, c, g, or t
  misc_feature (1444)..(1447): n is a, c, g, or t
  misc_feature (1479)..(1479): n is a, c, g, or t
  misc_feature (1486)..(1486): n is a, c, g, or t
acgttcagtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcccagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagcctacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttctggaaattgggacaagctgtcatcccaacaaaaaaagacccncacccaacccgggggaaaggaaaaaaaaatataatatagtttttttttatannnncgggagggggaaaaaaacaaaccgaaaaaggngccgagncaccaaaaccacgaaaaaaaacattttttctaaaaaggacttatatgtttatgcattaaataaaaataaaatcccatcaaagccttacttgtttaataaaataaagtgcaa

SEQ ID NO: 347682 - DNA, 863 bp, Homo sapiens
tataccacatccaaatggctcaagccggtggctagagataagaacttagcagcatttttctcacctagctgactggttcccctttctttaaacagacactccaggcacttgtttgtgaacttaaagtgccccacaccctatttccttatgcatactgctaactgccaaaatattctctctctgtccacctgaccctccattcctgcttcctgtgacctgggaatggagaattaccctctggactccttgtgccctccctgctcaggatatcagcacagagggacgaaggcaattgcctaccctgcttgagagatgcagaggcctggtgtggagttagcagtattatgagattggatcagcctggatcactgaatcactgcatgtaggacacactatggagagtttcttgtgccaagatcagacatggtatatgcaagaataaatgtgtgcgtgaatcaaaccagaggttgtgtttattttttaattactatattgtattcttgctaacctgactaatccagccagcaaccttacaattctaattatctgactgtagatcctcccaggttgtctatgtacataaacttgtcctcactttgcaaaagctaactatcttgtttcttttttttccaatcatgtcaacttaattttggcttatttgtttatttatgcactgaatgttgaattgaagagatatggtgaaaatattttacttgcttttgatttcgaaggaaaagctcttaaaatttactattaaatgggattattattggcaggtttttataaactaaggaaattacttgtgtcattctatttaagattctttcaatggatcatgcctggtattgaacataatctaataa

SEQ ID NO: 347683 - DNA, 804 bp, Homo sapiens
tataccacatccaaatggctcaagccggtggctagagataagaacttagcagcatttttctcacctagctgactggttcccctttctttaaacagacactccaggcacttgtttgtgaacttaaagtgccccacaccctatttccttatgcatactgctaactgccaaaatattctctctctgtccacctgaccctccattcctgcttcctgtgacctgggaatggagaattaccctctggactccttgtgccctccctgctcaggatatcagcacagagggacgaaggcaattgcctaccctgcttgagagatgcagaggcctggtgtggagttagcagtattatgagattggatcagcctggatcactgaatcactgcatgtaggacacactatggagagtttcttgtgccaagatcagacatggtatatgcaagaataaatgtgtgcgtgaatcaaaaaaaaaaaaaaaaaaaaaaaaaaaaaaatttggggggggcggggccgaaaaattttccaataacaattcgcgtggggggcgcggggccccaggtatgcgggaattgtgcacactgggtgacacaaggtgtggtacccacaaggagaggaccgggcgcatgagggacaagggggttgtggtgattcctccaacaatataaaaaaaacgcccgggggggaaacaacggaggtgcgctggaaccaaattccccaagaggaggagttccgggaggcgccacagcagggcctgcctaacaacagggggtgcccaaggggagccgaatatcaatttaacgccgcgctcgg

SEQ ID NO: 347684 - DNA, 268 bp, Homo sapiens
aaaatgcacattattcacttcacatagataatgtatataacctaaaattgaccaacgtatttaaagttttggtgtgtgtgatactggaatgtatattgctcctgacagaggaataaaccgggaccctactgaaaaacagtagaagactgataaaagactttgacttcgagaaagtatcttgacaaagaaagcctatacctttttttaacacttggataataaagcagttttgtttttttgtttttttttgttttgttttgttttgttt

SEQ ID NO: 347685 - DNA, 635 bp, Homo sapiens
gtggcaggaggactgcttgagcccaagagttttgagaccagcctgggcaacatagtgagaacccatctctaaaaaaaagttttaaaatattagctgggcatggtagtgtgaacctgtagtcccagctacttgggaggctgagatgggaggactgcttgagcctggtaggcggaggttgcagtgagccatgatcgcgccactgcactccagcctgggtaacagacccagaccctgtctcaaaaaaataataaaaatgaaaataaataaaagggtgccaaaataaatgaccccaaaataagttgttcctaaatgcacctttagtaatttaggaacgccatacaaaacatgtttttaacaaaaaatttttgaaaacaaaaataatcttttttagataagttctttctcaatgctaaattagattaaacaactttggtaacttattccaatgcctggagtccaagcaaaggtcacagattgataagcactcttctggctcacacacttgcttcttaatccaatgaatccgtaccatctctgtctttaagctatggataactaatgtaactttattaattctgcatattcacctaacattcattatactacacttaatatttactttgcattaaattatc

SEQ ID NO: 347686 - DNA, 661 bp, Homo sapiens
aaagtcagagctgtacactatgaacctccagaatttttttggtatttgttttatctaacatctaacaaaaataccttccatgttcaaggcactatgcagaatcagatagcatatatagggcccttatgtaatgcctttttattgcaatttagaccttggattttgtaacctgataagcaacaacatcatttctgttcagtatagctttctcaagtctctggtgatttagatcctctctcataaagtatattcttctcaggaaaggaatcttatattcagaatgatttataacaaatattatgagtgcatggcatgtgcatgtgtgttatgcataaattacatggttcccagactattttgtaggtcacggttgccgcttttctaagaagtgaaagtcagccattgtgctgtactacactgtcagggtctgttatctgaggtaaaatgattgcttctaagacatttttatgtgtccacatgagtggccacacattgagggatcattttcattttctgtcaagatagaaaccattaccaatttgttatgttttcttttacttggcaaattattctattcgcatttttggctgagctgctgtattggcatggtatacaacagacatttgggtaccattcagcagcattatactttttatgtaaa

SEQ ID NO: 347687 - DNA, 2364 bp, Homo sapiens
tccctcattcctatacttcagttttccttacctctagagcccctgaacagtagctcatatgttctccttttccttttagacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggctccaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtagccttgggaagcatctggctaatgcttccaactccatttgttcaccccactaccctccccctcttattccttttagccatgcttactatgttcgcctggtaacctcttactgccttagaggaagttcaccatacatagctgtgggtgcgtctgctctgatttaaatgcataatctggctagtggatgagagaaaggttggaaaaaaataaagaggctcatcaaagagggggagaaattat

SEQ ID NO: 347688 - DNA, 2899 bp, Homo sapiens
ttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcagaaacagtgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggctccaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtagccttgggaagcatctggctaatgcttccaactccatttgttcaccccactaccctccccctcttattccttttagccatgcttactatgttcgcctggtaacctcttactgccttagaggaagttcaccatacatagctgtgggtgcgtctgctctgatttaaatgcataatctggctagtggatgagagaaaggttggaaaaaaataaagaggctcatcaaagagggggagaaattat

SEQ ID NO: 347689 - DNA, 3022 bp, Homo sapiens
ttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcagaaacagtgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggctccaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtggaaattgagcaaaaaaaagagtttgaagccggactttgaaggagatgaaatggaaaatcccaaggagtgtggagtgcagtgacaaagccttgcggcaaggaatcctgatcccagagtcatgatagggtgtcttcctgagtcatgatagggtgtcttcctgagtagctgaagttgcagtcaatacctgctgtggccactgcatgttgggaacagtataccagatcttcctgtttgcagttacttgtattttaccaggaaaccctgagaatggtggcttttggagaggctctttgattctggtcatgcctaaagcacgaggttcacctgactgttggagcttactgtataattaagcctccttgt

SEQ ID NO: 347690 - DNA, 402 bp, Homo sapiens
gtgtgcttccccttgaaggtccctgggcacctggactagtggaggcaggctcctggctggctccctcaccaggtagatagttcaggctggcccacgtggatcactctgccccttcccatggctgagggctgccccctctaaatatagcccagtgggctgagctcaggcctattttaggccaaggctgggaggcagccaggccttccctgggctcacaaaggagccactgctgcatttgtccagtcctgctactggatgccatcattggcccccgactgcccactgcttgccatgcctgaggagacccaagaaggtaggagagggtgaccatgagggagggcaaggcctcagtcctgtgaccttgtggaccatggagagacccaccctctgtcccactgacct

SEQ ID NO: 347691 - DNA, 885 bp, Homo sapiens
gctgcatttgtccagtcctgctactggatgccatcattggcccccgactgcccactgcttgccatgcctgaggagacccaagaagactccgtggcgccaatgatgcccagccagaggagcagggggccattggcccccaaccacgtgcatgaggtatgcctgcaccaggtggagtccatcagcgacctacatagtggagcaggcacactgcgcccctatctaactgaagaggcacgaccgtgggatgagctgctgggcgttttgccgccgtcactgtgtgcccaggctggctgcagccctgtgtacagacgaggagggttcctgctgctgctcgcgctgctggtgctcacttgcctagtgctcgcactcctggctgtctacctgagcgtgctgcagagtgaatccctgcgcatcctggcacacacgctccgcacgcaggaggagacactactcaaactccgcttggccagcctcagccagcttcggaggctcaactccagtgaggcccaagcacccagctgagatgccatttggatctggggcctgggggtgtgtgttggtgggggaataaagtggctatgggcaggtctctccttccctactgctggctgccacatctacactatttccttggtgagatttttgtacaagaacctgttgttaacttaatggctgcctccctctcctgatctcttcaagccaggcctagccaagcctctggtgccaaagcctcgctttgggtggcccaaggtcaggggaaggggcaccagcctcctggctcctcctgtggcctgtcaacactctctggccaccccagatggcaggttctgaagtctagaaatagctgcccccatagcaatcacccaaactctgccagggctccca

SEQ ID NO: 347692 - DNA, 228 bp, Homo sapiens
cactattctagatcatattcttaacactatgatcttagtgttaagaaatagaaaatccttgactcctgccatatgtcagtagtgaaaatagacccttccaagaccatttccaatccttacctctagaaattacatgctgtttctgattttcagcacatctcaaagagattcatatttcccttgagttacagttgttgtagtttgtaaaaatgttcctatttctccata

SEQ ID NO: 347693 - DNA, 323 bp, Homo sapiens
ttttggtatcagggtaatactggcctcagactgagttgaacatgtactctgggggaagctagctgccatggaaggagtgacactattctgtgaccaccatgattttcagccaaggcaccagacaccagactgctgaagacatcctgggtatcctgcctagttgagttttcaaatcaccgcagtcccagctgccatttgactccaactgtatgagaggccccaggtgagatctgcccagctgagccctgtcagctcatattcagtgaactctgaatgtgagaggtaatatgaaattgttgtcattagttaccacatttagggat

SEQ ID NO: 347694 - DNA, 684 bp, Homo sapiens
gacaggaataatatctattccactgcattaagcggaattaaaagaggttaagtatgcagaacacctaggtaaatattcacagctttataaatgttaattcttttcctttattctatcccctttctcttcactgtttcagcatctatagcatttacatgtttattaaaggcatcttttgaatgctcttcaaagaaaagggcagactcttaccttaaagtagcaataatataatcccatcagtttttgtcagtagcttttgaaatggtataatattttattctactggactataaggcccttcacgggaaggactgccattctttgaaaccatattgcctagtagaccagtagtacttataatatggaaaacagattatacaacattaaaaggtattaagcatactttgtatcaaaaaatataacaagcactttgggaggctgaggtgggcggatcatctgagatcaggagttcgagaccagcctggccaacatggtgaaaacccgctctactaaaaatacaagaattagccatgaattgtggcgcatgcctgtaatcccagctactcagaaggctgaggcatgagaatcacttgaacctgggaggcagtggttgcagtgagctgagatcgcaccgctgcacttcagcctgggtgataaagtgagactcagtatcaaaaaaaaaaa

SEQ ID NO: 347695 - DNA, 543 bp, Homo sapiens
cttgttggccaagagattgatgaacctagaaggaacctagatgggaagtggcttgcataggtgcccagaagctgggctctggcatttgatgaactcaagttcacatgtgattccttcactttctagatgagtgatgttgggcaaacaagctctcctctctgtgccttggtttcctcatctgccattttggttagaatcaggtaggattctgtgtctcccctgctggacttgcttccttctatctgttctcttggccaaggccaatgtgttctatgtggcatgtaatttctctcctagaaattccacccgagcccaggaggtcaaggctgcagtgagctgtgattgcaccactgcaaaccagcctgggtgacagaatgagaccctgtttcaaaaaaggaaaatttcaatgccttggcattgtcttcaggggagagtgtaactcagtgttccagctcaggccctgtcttagctggcctttgctcacgtccccagtccgcctgcacctgctgtgcctgctgcagcctcactccaacaccagctttg

SEQ ID NO: 347696 - DNA, 610 bp, Homo sapiens
catcaactagtatgtggacatgagttcttgtggagagtaagttgaagaggtcagtatttaggtctctcctgtgtgaaaaatgtatctattctgtgcctcagcctcttttagctacactgcgttagctctccttatttccacggccagatccacagagaattgcctaggttcacactctctccagttcttcacctcttccttattcctccatcatagtagtctgacctgtacccctgctgctcccctgacactggttttgccagagtcatgaatggcattctgctgctgtattcaacaaagacttttcagtatttctcaacatctgtacgtttgctgttgttttcactgcttgcttgtcacaaggtcctagaacccatattggcctaatattccttctccctcagtgatcatattagagttagggccccaatgcttttctcttctcactctgcaaactcccttgagtactcctataagtaaaattaccacttaatattaattcctcttacatgttctgtagccacttcaaacttggcatgtccaaaatcaagtttctcttttttcccccaaaaagcctcctttcccttgactctcttgactctctcacctc

SEQ ID NO: 347697 - DNA, 342 bp, Homo sapiens
tgtgtgttttttttaaattaaatgccaggtatgttgtatagaagaaaagtagacactgaagcaaatgttcaaagtgggaatatctatccttccatcaagctattagcatggggctattagtcaatttagtcagcatttgtggtgaattgggttttgttgtagccatggttattttcagtgtgcaacagacttgaaatccctccggtggtgggctaggctgctcctattttgtgcttaatgttaagacctggagtgctggagagtggttgttgttttttccctctttccctgctccatcctttccatgcttttgttctttctccaacagtagatggctgttgt

SEQ ID NO: 347698 - DNA, 408 bp, Homo sapiens
ggtaaattcaatattagaaaatctactaacactatatgtcatattaatagatgtaagaggaaaaataatcactccatcaatcttctgaaatgctttcaacaaaactccccactcacacctgataaaactctaagaggaagtcctaatcagagcaattaggcatacatggatgagtctggagaacattatgttaagtgaaataatccaggcacagaaagacaaatgctgcatcttctcactcatgtgtgagagctaaataagttgatctaatggaagaagagtagaatcatggttaccagaggctaggaaggagcaggggaaaagaagatagaaagaggctgcagagttagacaggaggaataagttctagtgttctacagcacagtagggtgactatagctaacacta

SEQ ID NO: 347699 - DNA, 968 bp, Homo sapiens
tgagatcacttcccttgcacagtttggaagggagagcactttattacagaccttggaagcaagaggattgcattcagcctagttcctggttgctggccaaagtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgaaaaatatatttaagatttccttggggagaaatctcgtgcccaaacctggtgatggatcccttactatttagaataaggaacaaaataaacccttgtgtatgtatcacccaactcactaattatcaacttatgtgctatcagatatcctctctaccctcacgttattttgaagaaaatcctaaacatcaaatactttcatccataaaaatgtcagcatttattaaaaaacaataactttttaaagaaacataaggacacattttcaaattaataaaaataaaggcattttaaggatggcctgtgattatcttgggaagcagagtgattcatgctagaaaacatttaatattgatttattgttgaattcatagtaaatttttactggtaaatgaataaag

SEQ ID NO: 347700 - DNA, 1307 bp, Homo sapiens
tgagatcacttcccttgcacagtttggaagggagagcactttattacagaccttggaagcaagaggattgcattcagcctagttcctggttgctggccaaagggatcatggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgaaaaatatatttaagatttccttggggagaaatctcgtgcccaaacctggtgatggatcccttactatttagaataaggaacaaaataaacccttgtgtatgtatcacccaactcactaattatcaacttatgtgctatcagatatcctctctaccctcacgttattttgaagaaaatcctaaacatcaaatactttcatccataaaaatgtcagcatttattaaaaaacaataactttttaaagaaacataaggacacattttcaaattaataaaaataaaggcattttaaggatggcctgtgattatcttgggaagcagagtgattcatgctagaaaacatttaatattgatttattgttgaattcatagtaaatttttactggtaaatgaataaag

SEQ ID NO: 347701 - DNA, 1026 bp, Homo sapiens
tgagatcacttcccttgcacagtttggaagggagagcactttattacagaccttggaagcaagaggattgcattcagcctagttcctggttgctggccaaagggatcatggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaaaaaaaaaaaactggggggggggccggggccccgcgagaaagagctttctcaaaaccattgcgcggggggcggccgggggcccacagggggtcaggggaaccgggggccaaagcggggtcccaagagggaaaccgggggccgaggaacaagacggggccgggaatctctcttccaccaaattaaaaacaggccgcgcgggggaccacacgcgagagggtctcgcgtgaaaacaatatccccacaaggggagacttcagagagagagggaccaaaagaggggggcactcacaataaagagggggagcctcaaagcggaaactcgcgaatatcaaaatatgccccgcggcgggggcg

SEQ ID NO: 347702 - DNA, 1008 bp, Homo sapiens
actgaaatttgagtcttgagggctggtctgttctcgggagctgctctgttgaactctaaaaggaatcttgagccctgggcgagggagtggcctgacctggtggaaagactgcgggcctgcccgtggagtctatgtctggccctgcctagctcagtcaatctcagcagctcatgtctcctcttagaccctcagattcctcatctacagaaggagaaagaagaggagattgaatgatttttaaggtctttatcagcttctaaaagtttgatttgatggttgtaggagcaattgttctttcaaagcaccatcttctaacctcaggaaggaaagcccaggggcccctgggatgtcctgccaaactgggaagacaaagattgtgactgagaaggtgggggcagggcaggagaagggggaagaagggagaatggatcaaccccaggccggggaaagagatgaatgaaggtccacgccagagtgacatgctctaagtaggggaaatcttcctaactagagttcccatgactttggcaacatttgaaaaaaaaaaaaaaaaaagacatcctttaacccacaaagtactcaattgtccaagccccagttatggccaacttcccaaagctggctggtcagagaccttggtgttaattcctcagccaactaaaaaaagatggtgtaagttctgttgacttaattgttggagtgtttctgagtggggccgcctccctcctctgcctcctcacagtattatgggctattctgcattacctgccctacctatcttcataatctagccgcaaacagctttggttgaccacaccacttccctattgaaagttaatactgtttgactcattctgtgttactaacctgaagccaaagaaaacaaggcagagaataactggcttgtgtggagtttggaaagctcttggaggccctgctttcaaaatcctatacagtagctttactatatctctccgctgcagctgctgagaaaatgaaggaagcaga

SEQ ID NO: 347703 - DNA, 377 bp, Homo sapiens
ggaatgtggaaagaaacgaggttaatatcttttgggaaattaatttgtgccaaactatttggcttcttcgtcctagttgcattgtctccctgacctcatctcccctgagaatcagcctctgtttccctggtcaaggccacggcttttctctgatcctgaggagagtttcctaccagagtggaagcagggaggactgaaagcactaggaacagaggggagctatcggattgcatctagaacctgctgtgagcaacatcttcagaattaaccataatgtgttccctcctttcctgtgtccagatgaggaaggagaactttgattcttccttccaattacattctgcgagaggatcttatgtgttgggaggccattgggg

SEQ ID NO: 347704 - DNA, 751 bp, Homo sapiens
gggactgtgggagagatggagagagactggtacagaaatggtgagacaaggagagagccataaagaggaagacagagagaaagaagacaaatgcataaagaggttcagagacgtgtgactgtggagatcgaaggcctggttttagggctagcgaacaccttctccctttggttttggtccacagaagactggtgatacagactccttatcagtgtaattgtggggactggtcaccagctcttgcttgagcttttccagaagaaacttcactactgaaatattccaagaggacttgatgctgccacaaagagaagagaatgaataaagttgtcggctttgtaagagccagacaaacagagatacccagcactaatcaactttgtggcaaatccctccacagcctaagaaggatccctagcagcaatcctcaagagcctcagcagattggagagatgcctctttgattctgtcccagagctaaagattggaataactgtccctccccctctaaacccacagtctgccacaagaacattttaaaccttcctccatgatgggcagcagaactccctgactagtcctccagatccttctcaagcacagaatagagagagcatgatggtgagtgaggatactgtccttcctgcaggtcttcagttccaccacactctcctaagggaaggaagaagccaggcctcaatgctgtacctctctctggaggcagcaggcacaagtggaatggaagtgatgg

SEQ ID NO: 347705 - DNA, 848 bp, Homo sapiens
gggactgtgggagagatggagagagactggtacagaaatggtgagacaaggagagagccataaagaggaagacagagagaaagaagacaaatgcataaagaggttcagagacgtgtgactgtggagatcgaaggcctggttttagggctagcgaacaccttctccctttggttttggtccacagaagactggtgatacagattgcattgtctccctgacctcatctcccctgagaatcagcctctgtttccctggtcaaggccacggcttttctctgatcctgaggagagtttcctaccagagtggaagcagggaggactgaaagcactaggaacagaggggagctatcggattgcatctagaacctgctgtgagcaacatcttcagaattaaccataatgtgttccctcctttcctgtgtccagatgaggaaggagaactttgattcttccttccaattacatccaaaatatccacacaactactaatatttggaagctttgatcctttggggtgaggatgcgagaggaaatcttatgaaatgttgggaggccattaaaggaggcccatgcaagagttggtggtagcaatgggcacaactgggatgaacagcctgtgttttcaagggataactggaagcagagatgagtgaaggggaagaagtagaagacgcatatgctaatagggcatgctccaatagtgctcatgacctcaggtggcctctccacagtctaaactggagctgggatctccaaaggccctcttcgttcccaagactttaattataatctgtatatgcaggtgactccctaatccatatttccagcccagtctttcttggaattaaa

SEQ ID NO: 347706 - DNA, 349 bp, Homo sapiens
taggacctctgataattcagacaaaaaatggggggaaatttacagttttttgcgacagttgagtgcggatatttcttaaatgcggagtccacattaacttaattcttttccatagtcctgtaatggaggtgccttcgtgatctgtgtttttcctttgccaccctttctaatgtaagatttgaagtgtatgagacaatttatgtcatgtttgtaagttataaagcctaataaatagacttaaaaacctgagaagttgccatcccacccaggactggaacctcactgctaagtcgcatccacctgcgtgctcctccccacccatttttttttttgagatgaagtttcgctc

SEQ ID NO: 347707 - DNA, 806 bp, Homo sapiens
gacaggacctcccgtttggcatttcgttttcagatgtgcctagaagaaggagacaactgcctcttggactgttgaaacctggttctgcttgaattgtcaagatatcacctaaatcctatccatattttgtgcagcaggtttgtggacgcctaccaccattcattcattgcagtggctcagagaagatgaaaagaggactctgtggccaatgaagatcctcgacagagctcacatgaccagagtggactggcttctaccctaaatacacatcacgatatttctcactctgaccttgctccactttatacaacaccacacagctcgagagtggctgagctgccgtgggaacccgaatgccatctgactccaaagccttactctcaaccaccactctgatgcctcctattctttcctgaaatcttcagtatagtcattattatggagtaaaaaaagaaaaaggaaggaaggaaggtagagggagcccctctatctccattctttgtttccatgaagaacctccagtccattttcgggggcgtgctgttggtgtaacatactttctggccctctctctcccattcctgtcactcattgtcccccaggaagaagccatatgtggatgataagactggaagaagccactcttaagttcggtggtgtgctggtaaatgtttagcagctggctttggggcagcaagaaagtcctgagttgtagcacgtgccattctccatggtgtaaaaacacttccgccatagctgcttccaagtatgtaaattgtacctcaataaagccaatttaaaaagta

SEQ ID NO: 347708 - DNA, 431 bp, Homo sapiens
agtcagtaaacaaacaagctgtccttggagcaagcaagcgcttccctttcggcatctccccctctctgagcggcagccctgcaagtgaggccaatagccgtccctcagctgtgtacaggacaggcattcttggacctcagagtcctgcagtagcattttgaggacgccaagttattgatggggacaggtgctcataattcagcataacccacccaagccgtgtttcactttttctggaaacctcttgatttaggaatgaaagcccctggctccccctgggctgggctggccagtaaacatctcagtctgagtttgccgaggtgggttgctaaatttaattgccagtttccacaccatgtgatggtgtgtgacaggccagctcaccctgtgagttagccaaggggttttaaataaatgctttctgacggaaa

SEQ ID NO: 347709 - DNA, 551 bp, Homo sapiens
cacccacccaaccatgactccaccatggcactgtcaccatggcttctccagcctcagcttgtaggcctcgttggatggatgtcctttctgtctttggacagcccttagccacatactgcacttctggttgagctgaagtttgtcccaccccccagtgctgtttccttgtgacagcccttgtcctaggctgaacatccctagttccttcagccactcctctggggaccaagtccagaccctgaagtcagcccttcagtgggggtcccagcactgggatggtgggtccagccagtgatgaggtccagtgacccacacctcttcctgtgaccactggcgggagaagaggcaagtgggaatagaggaacggctgtgttggcctggccagcagcctgggttgagagagggaggtgccactgtcctgcctccttttgagcccccttgctcagtgtcagaaccctccgctggctgtccccgccgtgcgccacggctccaatccctatatgagtgagcagtagaatcacataggaataaaaagccatagagaacagcga

SEQ ID NO: 347710 - DNA, 549 bp, Homo sapiens
cttgagctcaggagttcaagaccagcctggccaacattgtgaaaccccatctctactaaaaatacaaaaattagctaggcatggtggcaggcacctgtaatcccagctactcgggaggctgaggcaggagaatcacttgaacctgggaggtggaggtcgcagtgagctgagatcatgccactgcactccagcctgggcaacagagcgagaccccatctcaaaaacaaaacaaaacaaagcaaaacaaaaacatgaggggaaagactgaatagataggtgacttagacatgcactcaggtgaccaaccaggaggtccgatctttgagtttatgctcaagccacagaacattattattcacttagtgtttaacttcaaataaattgatagttggaaacaaaacaaggacaataccttcataattttaattttttaaattattaaatattttttggtagagatagggtcttatgttgcccaggctggtctcaaactcctagcctcaagcaatcttcctgccttaacatccaaaagcattgggattacaggta

SEQ ID NO: 347711 - DNA, 1867 bp, Homo sapiens
gaagccgccggggccgcctagagaagaggctgtgcttcggcgctccggctcctcagagagcctcggctaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347712 - DNA, 1191 bp, Homo sapiens
cttatctgtgactctctcttcttgagatgggataatgtattggattattagagaagtgtgagtattgaatcagatagttttattttatctagagcagggttaaacctgatgaattgtttctgctctctcatggagtatatcttcttggtgacaaagacttttctgtctctgatttttatcttagtcgtggttacatttaataatcctgctttccagcttttcctagagatcagtcatcagtgaccttttgtcttgatactttgtcaccttttgttttctggttttgggttttttttttcttttttaaacatatgtaacattggcttttcctgctgacaacagtaacagagtttcagatcatgtttatagaatggttatttcatcacctaactaatctcacctctagtgtatggattctggtaaagtcagtcaacagtcttcacagccttttctatttttactgaccttgatttaaaatctaatcttagaccttgaggtattgcttacgaatagtgtaataatgaggtactacttataacaaataatggtaacatactctagtgcgtactataggcaaaagctaatggaaacataggtagaagaaatgaagtaatagttattgaatgctttttgtgtactgcaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggtgaagttgctgtgaacattgttaaaatgccaataaaggatttaggaattacagaaacctggttgataaagcagtgccagggtgtgagagagttgacttcaattttgaaataagttccactggctgggtgtggtggctcacacctgcaatcccagtactttaggaggccgagactggtagatcatttgaggtcaggagttcaagaccagccttgccaacatggtgaaaccccacctctaccaaattagccaggtgtggtgcacacctgtagtcccagctacttgggaagctgaggcaggagaatctcttgaaccagggaggaggaggttgcagtaagccgagatggcgcccctgcactccagcctgggtgacagagtgagaccttgcgtttaaaaaaaaa

SEQ ID NO: 347713 - DNA, 645 bp, Homo sapiens
  misc_feature (602)..(602): n is a, c, g, or t
  misc_feature (633)..(633): n is a, c, g, or t
  misc_feature (637)..(637): n is a, c, g, or t
gaagccgccggggccgcctagagaagaggctgtgcttcggcgctccggctcctcagagagcctcggctaggtgtggaaacaggaagagaactagaactggaagtaaagcattgaagatgtgactgaattgctgcaatctcatgatcaaatttgaatggatgaggagttgctttttagggatgagcaaagttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttaaaaaaaaaaaaaaaaaaaaaaaaanaaaaaaaaaaaacaaaaaaaaaaaaaaaaanaaanaaaaaaaa

SEQ ID NO: 347714 - DNA, 354 bp, Homo sapiens
caccctgatgagtcagtagccatcgttaacgttggcgtaagaccctccaccagcaaaaagattgttagcatttttttagcagtgatgtatttatcaattatacataatgctattgtacacttcttaatagactatggtatagtgtaaccataatttatgcactgggaaaccaacaaattcatgagattcgctttattgtagtgctctggaattgagcctgccgtgtttctgaggtatacctgtgaaagaaacggcgacagaaaaacaagtaataactggtcattccaccggtgtcccacaaccaagaaggtaagggcgttccataaccgtcctccgacaagcatcttggggctt

SEQ ID NO: 347715 - DNA, 2269 bp, Homo sapiens
caccctgatgagtcagtagccatcgttaacgttggcgtaagaccctccaccagcaaaaagattgttagcatttttttagcagtgatgtatttatcaattatacataatgctattgtacacttcttaatagactatggtatagtgtaaccataatttatgcactgggaaaccaacaaattcatgagattcgctttattgtagtgctctggaattgagcctgccgtgtttctgaggtatacctgtgtatttagtatgttccttgtatataaaaccccattttatagggtaggaaactaaggcttagagtttgagcaattttcccatagataacaccaataaattgagggctgcagagaccacttaagtggttctcttaacagtagtctagacatgacgtaatgagatttggcttaggagtgacaatggtaaggaagttaaaggattcaggaaccaaataccagttattgagaagaaagaatggcctcaaaacatcacttctcaaggaagccttgataccctcacccttactacactgtatcctccatttgaatgttgtcaagagctcttctcacaattgtaaataataattgtgtaattttgttttttttttcctactttaggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347716 - DNA, 2440 bp, Homo sapiens
cttatctgtgactctctcttcttgagatgggataatgtattggattattagagaagtgtgagtattgaatcagatagttttattttatctagagcagggttaaacctgatgaattgtttctgctctctcatggagtatatcttcttggtgacaaagacttttctgtctctgatttttatcttagtcgtggttacatttaataatcctgctttccagcttttcctagagatcagtcatcagtgaccttttgtcttgatactttgtcaccttttgttttctggttttgggttttttttttcttttttaaacatatgtaacattggcttttcctgctgacaacagtaacagagtttcagatcatgtttatagaatggttatttcatcacctaactaatctcacctctagtgtatggattctggtaaagtcagtcaacagtcttcacagccttttctatttttactgaccttgatttaaaatctaatcttagaccttgaggtattgcttacgaatagtgtaataatgaggtactacttataacaaataatggtaacatactctagtgcgtactataggcaaaagctaatggaaacataggtagaagaaatgaagtaatagttattgaatgctttttgtgtactgcaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347717 - DNA, 2201 bp, Homo sapiens
gggaatatttttctgcctttgaagatattctcacaagatcgttctccacgcccaaggcaagtaaaacgacacaatctggctcaactccaggctcgaaccctacacattcaacgaggctatctcagacacgctgtggcacacgccacggggagccagagaacgtgtggtgggggtggcgaaggtaatgcctttgggaagcagccatctgaggtgggaagccagaaaacgagagggaaggcgtccaggaagattacggaggggagatcgcggcccccagagcgatcagagttgtctgtcacaaggccgcgagaacgggggtagggagtgggggatcggggagagaaaaaaagtatgcctgtgtatttcgagcggagggcagcaagaggcctctcctcaagggaaaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347718 - DNA, 1903 bp, Homo sapiens
aggcgggggcgggctgccggccgagacttctggatggcggcggccgcggctccgccccgggttcccaccgcctgaagggcgagacaagcccgacctgctacaggcagtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347719 - DNA, 1837 bp, Homo sapiens
gaagccgccggggccgcctagagaagaggctgtgcttcggcgctccggctcctcagagagcctcggctaggtgtggaaacaggaagagaactagaactggaagtaaagcattgaagatgtgactgaattgctgcaatctcatgatcaaatttgaatggatgaggagttgctttttagggatgagcaaagttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347720 - DNA, 1377 bp, Homo sapiens
gaagccgccggggccgcctagagaagaggctgtgcttcggcgctccggctcctcagagagcctcggctaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347721 - DNA, 1413 bp, Homo sapiens
aggcgggggcgggctgccggccgagacttctggatggcggcggccgcggctccgccccgggttcccaccgcctgaagggcgagacaagcccgacctgctacaggcagtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347722 - DNA, 1265 bp, Homo sapiens
aggcgggggcgggctgccggccgagacttctggatggcggcggccgcggctccgccccgggttcccaccgcctgaagggcgagacaagcccgacctgctacaggcagttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347723 - DNA, 2103 bp, Homo sapiens
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggtgaagttgctgtgaacattgttaaaatgccaataaaggatttaggaattacagaaacctggttgataaagcagtgccagggtgtgagagagttgacttcaattttgaaataagttccacatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347724 - DNA, 1888 bp, Homo sapiens
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtacaattctcctgcctcagcctcctgcataactgggactacagggaagcaccattttccacaaaactctcaagaaggacttgttgcaactggaaaagcaattaaatgtgaatcgtgatccaggagaaagtaacaactcacataactcccaaattaaaagttttccaaagatatatcatttttttttttttggccttttaagaaactagccaacaaatactcttgacaggtttgtgtttggttttgaaaacacacaccttagtgtactgaaagaaaaacaatttcttttaatttggtttgttggtcccacaccccatctatcaatgtatgtgctatttacaaataagttctatacagtatttttgcagtacct

SEQ ID NO: 347725 - DNA, 1099 bp, Homo sapiens
caccctgatgagtcagtagccatcgttaacgttggcgtaagaccctccaccagcaaaaagattgttagcatttttttagcagtgatgtatttatcaattatacataatgctattgtacacttcttaatagactatggtatagtgtaaccataatttatgcactgggaaaccaacaaattcatgagattcgctttattgtagtgctctggaattgagcctgccgtgtttctgaggtatacctgtgtatttagtatgttccttgtatataaaaccccattttatagggtaggaaactaaggcttagagtttgagcaattttcccatagataacaccaataaattgagggctgcagagaccacttaagtggttctcttaacagtagtctagacatgacgtaatgagatttggcttaggagtgacaatggtaaggaagttaaaggattcaggaaccaaataccagttattgagaagaaagaatggcctcaaaacatcacttctcaaggaagccttgataccctcacccttactacactgtatcctccatttgaatgttgtcaagagctcttctcacaattgtaaataataattgtgtaattttgttttttttttcctactttaggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattcta

SEQ ID NO: 347726 - DNA, 2140 bp, Homo sapiens
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggtgaagttgctgtgaacattgttaaaatgccaataaaggatttaggaattacagaaacctggttgataaagcagtgccagggtgtgagagagttgacttcaattttgaaataagttccactggctgggtgtggtggctcacacctgcaatcccagtactttaggaggccgagactggtagatcatttgaggtcaggagttcaagaccagccttgccaacatggtgaaaccccacctctaccaaattagccaggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtacaattctcctgcctcagcctcctgcataactgggactacagggaagcaccattttccacaaaactctcaagaaggacttgttgcaactggaaaagcaattaaatgtgaatcgtgatccaggagaaagtaacaactcacataactcccaaattaaaagttttccaaagatatatcatttttttttttttggccttttaagaaactagccaacaaatactcttgacaggtttgtgtttggttttgaaaacacacaccttagtgtactgaaagaaaaacaatttcttttaatttggtttgttggtcccacaccccatctatcaatgtatgtgctatttacaaataagttctatacagtatttttgcagtacct

SEQ ID NO: 347727 - DNA, 1260 bp, Homo sapiens
tcccctcaaatatattgactttttcattcccagtaacaatatgtctggtctgtaactaagtcattccatgttcagattacagatttatttccccatcttttcacattcttttagtccaggagacccactttgaaggttaaaaccaaggtcacacaatgaataggtggcagtgtcacatataactcagctccaggccttatgaatcctgcttatagcccactgcctattctagtcaccagattgaaaaacaccatactagggaagaagatggcaaactattgcccactacatatttgtatcagtcttgtcaaatttttattgtagtatgtaatagaattaaagctatgatgaatcaagtaaaaaatgatttccttaaaaactaagctaataggcgaaaatactcgcttgttcaacaaatacccagtctggcagatacaataccctgcccttagtggggggtggagtggggggtgggggggtggggaaagacatcgtggtgaaaacagacatggtccttgaacttcctggttctgtgggttgcttaatttgaggtttaaatggtttctcccatcaggtgaaaagttttgtgttcggcccataaacaaagcagctgtgaattctgatagtggtaaaaaggccagtctaggatataaaaccttcataaacatcttatttcccattcattatgaagtgtggggtaggagatcagagaaaccagatgaggattgctggctgtgctgctaatgtgaactcttctttcaaaagtattgtgtccttttattctcaatggagacatcagaaagtattaagaggagtactattataatactaataggatactgaaaatctatactgattgcagccagaggctccaaaataaacaatactatgatgagttccacaaaaaaacctcaactactctttgttccagggaagcaccattttccacaaaactctcaagaaggacttgttgcaactggaaaagcaattaaatgtgaatcgtgatccaggagaaagtaacaactcacataactcccaaattaaaagttttccaaagatatatcatttttttttttttggccttttaagaaactagccaacaaatactcttgacaggtttgtgtttggttttgaaaacacacaccttagtgtactgaaagaaaaacaatttcttttaatttggtttgttggtcccacaccccatctatcaatgtatgtgctatttacaaataagttctatacagtatttttgcagtacct

SEQ ID NO: 347728 - DNA, 1805 bp, Homo sapiens
  misc_feature (1762)..(1762): n is a, c, g, or t
  misc_feature (1793)..(1793): n is a, c, g, or t
  misc_feature (1797)..(1797): n is a, c, g, or t
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtactgactgcaacctctgtctcctgggttcaagcaattctcctgcctcagcctcctgcataactgggactacagggaagcaccattttccacaaaactctcaagaaggacttgttgcaactggaaaagcaattaaatgtgaatcgtgatccaggagaaagtaacaactcacataactcccaaattaaaagttttccaaaggattaaaacaaaaaaaaaacaaaaaaaaaaaaaaaaaaaaaaaaanaaaaaaaaaaaacaaaaaaaaaaaaaaaaanaaanaaaaaaaa

SEQ ID NO: 347729 - DNA, 1215 bp, Homo sapiens
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggttaggcaacatctccctttttcttcctctaaatacctctcatttctgttcttacc

SEQ ID NO: 347730 - DNA, 910 bp, Homo sapiens
gggaatatttttctgcctttgaagatattctcacaagatcgttctccacgcccaaggcaagtaaaacgacacaatctggctcaactccaggctcgaaccctacacattcaacgaggctatctcagacacgctgtggcacacgccacggggagccagagaacgtgtggtgggggtggcgaaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtacaattctcctgcctcagcctcctgcataactgggactacagggaagcaccattttccacaaaactctcaagaaggacttgttgcaactggaaaagcaattaaatgtgaatcgtgatccaggagaaagtaacaactcacataactcccaaattaaaagttttccaaagatatatcatttttttttttttggccttttaagaaactagccaacaaatactcttgacaggtttgtgtttggttttgaaaacacacaccttagtgtactgaaagaaaaacaatttcttttaatttggtttgttggtcccacaccccatctatcaatgtatgtgctatttacaaataagttctatacagtatttttgcagtacct

SEQ ID NO: 347731 - DNA, 687 bp, Homo sapiens
aggcgggggcgggctgccggccgagacttctggatggcggcggccgcggctccgccccgggttcccaccgcctgaagggcgagacaagcccgacctgctacaggcagttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtacaattctcctgcctcagcctcctgcataactgggactacagggaagcaccattttccacaaaactctcaagaaggacttgttgcaactggaaaagcaattaaatgtgaatcgtgatccaggagaaagtaacaactcacataactcccaaattaaaagttttccaaagatatatcatttttttttttttggccttttaagaaactagccaacaaatactcttgacaggtttgtgtttggttttgaaaacacacaccttagtgtactgaaagaaaaacaatttcttttaatttggtttgttggtcccacaccccatctatcaatgtatgtgctatttacaaataagttctatacagtatttttgcagtacct

SEQ ID NO: 347732 - DNA, 2956 bp, Homo sapiens
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347733 - DNA, 3433 bp, Homo sapiens
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttcaagcacatttggttgaatctgcagatgcagaacctgaggatatggagggctgactgtgctaatacgttatcaatggatgcgtgcataaacatggctggacttgttacttggcttgtatttgccaggcatcagcaccaactagttaaagatactcttacgtgaaagcttggcaacaaacacatgtcctgaaataatgcaagtgtagaataactttttaaaatctcatggtttatgctaaactatatgttgacataagagtggtgataaggcaacagtaggtaaaagtaaaatttcaggcaccttggcacaaactgtggcagtggcatcaaactctaagttatttttcactgccatgcatttgtggtgtgaacccccacaaaagaaaaaaaccagtttcactcaagaatgtccttgtgaaagcagtgacattttgttaaatcttaaaccctacagtacataactttttgaaatggttgtc

SEQ ID NO: 347734 - DNA, 3047 bp, Homo sapiens
  misc_feature (2186)..(2187): n is a, c, g, or t
  misc_feature (2218)..(2218): n is a, c, g, or t
  misc_feature (2255)..(2255): n is a, c, g, or t
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaacaactcgccacacatagnnccactttaaccctaaccccctaacctcatanacccatccgacgcccccccctcagcgccgaaccttantcccaaggcggcggcccccctaaaagccttaccatttcttcaccaaaacccctcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccaaaacccaaggatgttgaattcccttttataaaatggcgctgtatctgcatacaacttacacacatcctcccatatactttaaatcatttccagatttcttatacttcatacaatgtgaatgctatgtaaatagttgttacattgtgtacttatatttgtactattgtattaaatattctcaaatattttca

SEQ ID NO: 347735 - DNA, 2916 bp, Homo sapiens
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattctaaaatatttatatattttttcatttaagaatggatcggcttaaaaagactgcttctcatttacttactggctataccatctgtatactaataaaaaacaagatttgatttggaaggactgactcaaactaacgaaaatatgaaacctgtctttctgctttggagatatttacctaatcatgttctgcagtagaataatttagttcttttgtctttttttggagatgaggtcttgctgtgttgcccaggctattcacagctgccatcatagtgaactacagcctgaaactcctgggttcaagagatccttctgcctcagcctcctgagtagctggaactataggcatgcgccaccaagcctgggcttttaaaaaaattttaaaaagaattttgagacaggatcttgccatgttgctcaggctagtcttcaactcctagccctgagtgatcttgctttgggcctctcaaaatgttgagttaataggcgtgagccaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactgggaaaaaaaaaaaaacaggttttaaagctagaaatgaaaagctacttaactatcttaaaggataagttactttattatacactagaaacatacacaatagctgaaaaacttaaaaaatctcacactgctgaatgtctctgctggctgaagtgtaagtaaaagatcatagtagtgccgctgttgagtgatacagcaacttgtcattaaagatgtgtgtgcagacatggattctgagttaatatctcatctgtagaagtatatatttgtcccttgctttgggattggtttctggacaccactcccccacccttgctggccatttgccaaggacaccatacccagccaaaaatttttttagagatgggaatggaatgatcttgaatagtgttggtgccacctatgttgtggcatcattttgaaaccaatcattcagagtgctttttttggtaaggcattattttttaatgcaggtatgccactactggg

SEQ ID NO: 347736 - DNA, 1786 bp, Homo sapiens
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtaggtttaggtatgcatacttgtttttagaaattatttttttcctttttcccatttttagaaatcaactcattttttaggttatgccttcagtaatctttgcaacctcaatattgtgtaatggttactttaaaatactgtagttttctttgtgcctaagtataaacataagtacattttgttgttttgtttgcaatagtggtttaaatattttcccaaaatatccaaatttaaaaattctacaactttagaatttaataaatttattcta

SEQ ID NO: 347737 - DNA, 1858 bp, Homo sapiens
aggcgggggcgggctgccggccgagacttctggatggcggcggccgcggctccgccccgggttcccaccgcctgaagggcgagacaagcccgacctgctacaggcactcgtgggggtgggggaggagcgggggtcggtccggctggtttgtgggtgggaggcgcttgttctccaaaaaccggcgcgagctgcaatcctgagggagctgcggtggaggaggtggagagaaggccgcacccttctgggcagggggaggggagtgccgcaatacctttatgggagttctctgctgcctcccgtcttgtaaggaccgccctgggcctggaagaagccctccctcctttcctcctcgcgtgatctcgtcatcgcctccatgtcgagtcgcttctcgattatgggcgggattcttttgcctaggcttaaggggctaacttggtccctggggcgttgccctgcaggggagtgagcagctgtaagatttgaggggcgactccgattagtttatcttcccacggactagagttggtgtcgaggttattgtaataagggtggggtagggaaatggagcttagtcattcacctggggctgattttatgcaacgagactgcggattatcactacttatcatttttggagcatttttctagagacagacataaagcatgatcacctgagttttataccatttgagacccttgctgcaccaccaaagtgtagcatcaggttaaatcttaatagaaaaattttagcttttgctttgagaaaccagtgcttccctccctcaccctctctccccaggctctctacccctttgcatccctaccaggcatcttagcaactctcactcatacttgatcccattttccatttgttgtacttgctcctctagtattcagacatagcactagctttctccctctcttgatcttgggtagcctggtgtctcgcgaaaccagacagattggttccaccacaaattaaggcttgagctggggcttgactcttacccagcagtgcttttattcctccctagttcacgttcttaaatgtttatcttgattttcattttatcctttttccttagctgggattctgtccctgaccgtcttcacagtccaggtgatcttgactactgctttacagagaattggatctgaggtgtggaaacaggaagagaactagaactggaagtaaagcattgaagatgtgactgaattgctgcaatctcatgatcaaatttgaatggatgaggagttgctttttagggatgagcaaagttgctccttgagggcaggacagttcttatggctttatccgttgcgtaagcacagagaggtctgcgaggtcaaaactattgtcatgatagcaagatgcctgtctttttcatttattctcacggtgtgcagaggctacatgatgtgtgatgacatcctcattgatgttaatgaatggtgctatacttgaattttctaaggtgtcattaggtacaattctcctgcctcagcctcctgcataactgggactacagggaagcaccattttccacaaaactctcaagaaggacttgttgcaactggaaaagcaattaaatgtgaatcgtgatccaggagaaagtaacaactcacataactcccaaattaaaagttttccaaagatatatcatttttttttttttggccttttaagaaactagccaacaaatactcttgacaggtttgtgtttggttttgaaaacacacaccttagtgtactgaaagaaaaacaatttcttttaatttggtttgttggtcccacaccccatctatcaatgtatgtgctatttacaaataagttctatacagtatttttgcagtacct

SEQ ID NO: 347738 - DNA, 952 bp, Homo sapiens
gggaatatttttctgcctttgaagatattctcacaagatcgttctccacgcccaaggcaagtaaaacgacacaatctggctcaactccaggctcgaaccctacacattcaacgaggctatctcagacacgctgtggcacacgccacggggagccagagaacgtgtggtgggggtggcgaaggtaatgcctttgggaagcagccatctgaggtgggaagccagaaaacgagagggaaggcgtccaggaagattacggaggggagatcgcggcccccagagcgatcagagttgtctgtcacaaggccgcgagaacgggggtagggagtgggggatcggggagagaaaaaaagtatgcctgtgtatttcgagcggagggcagcaagaggcctctcctcaagggaaaggtgtggaaacaggaagagaactagaactggaagtaaagcattgaagatgtgactgaattgctgcaatctcatgatcaaatttgaatggatgaggagttgctttttagggatgagcaaagaaagtggtttctcgagatggaatctactggtgaagttgctgtgaacattgttaaaatgccaataaaggatttaggaattacagaaacctggttgataaagcagtgccagggtgtgagagagttgacttcaattttgaaataagttccactggctgggtgtggtggctcacacctgcaatcccagtactttaggaggccgagactggtagatcatttgaggtcaggagttcaagaccagccttgccaacatggtgaaaccccacctctaccaaattagccaggtgtggtgcacacctgtagtcccagctacttgggaagctgaggcaggagaatctcttgaaccagggaggaggaggttgcagtaagccgagatggcgcccctgcactccagcctgggtgacagagtgagaccttgcgtttaaaaaaaaa

SEQ ID NO: 347739 - DNA, 2950 bp, Homo sapiens
tcctcaaaagaaacaatttatttagaataaaacaaaagcagctcaactgtgagcgcacgtttgagagacagctactcttaagctgtgtgagccataaaaagggtttttctttacttttccagaaatcttgtgtacacagcacaaatcaaagaggtcattttttttccacttaaaacaccggcattggcatcacaatagcagatacacaactttaagctgccattttagtaaaatgcacaaatactaaacagattagctttcttccatcagaggcccatgtaaactccacataagccacaacttctcttcaaaaaggtccattagagctttgaattccatatcttcatccgctgttcaaccagttttgcttgcggagggggggaaaaaaaggttattcagtacaaatgtttacaatattaaaaatatatatatttcccctatgccattatagatgaacataacattaacaagaccttcctggatggttcacctcaacttcaaaaagcaccaataatacccactggcataaaccttgaaatgaatttactgtatgaatagacatataacaagtagaacaatagggtgggtttttttaaagactgcaattgaagataacaggactgaaaatatcctttaactcatgtaactgagtaaaacatgttgaaaaaattcagaaaaaagtttcacaatcaatttataatctatcaatatattctaaatataacttaaaaagtgaaactataaaaaggtaaagtttagtcaaacttttgccccatctattttcattctgtaatttatatggagcaacatagactactccattattgtagaaaggggtcgatacaaagccatttaaaaatccaccctcatctatgttaccaaagacagcagccgttattttaataaaacactcatacaaataattgttaaacagccaaagaacacttcaggaatctcacttttcaactctgtttaaaccatacatataaaactcttcattcagcttaacatttcactgtggttacctgaaatcatttcctccctttagggacaccactataaccactataacagggtcagcgccaagttttctctcttcttgttctcatacctaactcctatctgaaaaccaaaccctgtgagagagacagaaaaaaaaatgtccagaaattctctccaaaatttttttcacataaaaggtcattaaggccctcttctcaagaggatttcctaattctgttaccagagtttttggtgattggttcctatatggacccaaactatagttcaagctgtatatgcataatgaacaatctgccttaaaaaagtggatttacattttttatttttaaaaaagcattgtcagtgaaaacctgctaatagtttttaaataaacctaaacaatgtctgactctgaaagcaataaccaaacacctgactcttattactggacctaaaatgacctgtaactgagtcaagaagggccagagtatattttaccttcaaaaggtgacaaatgcttataaccagccaggcgatggacattttaagatgtaatcctcaaaagaaaaactctatccactctcagttgagagtcaaagtacaccagaaatttaaaactttgtgtgaaaaattatttataggaatcccaacaaaatacttaaccaaaaagttaagcagaactattggctaggtattgcttgcttaattttccataaaatttgaagctgtgatctaaaagtcttatcttcacgtttttaccaataatacttaatagtcattaaatgatatcctgaagttttctttccattcattttaactgagttccagaaaaatcaactacattaaaataattaaagaagaaagatagaaaaaaattggttgttacaaagaacattcaacgttgggattattaaatcctggctaatgagaagtagaaccggttttagacttttgctttcatttgaattcttaaggtttaactagatactttatggatattatgaacctgcacaaaagaatgggcagtacaaatatgaggttcatgtggactatggcactctgtaggtaatgaccaactaaacataattagttttttataatacatacatttagaaatggtatcaagccattgtttcaaaaacactgaagcacaaattgcccagacctaacaaaagcggcaatgtcaggtaaagattcaaacaaacatggagcaaaaacatagtactcttctgtacgctgtcacactaacaaaaaacaaaaaacaaacaaaaaaaaagaaagtaaaagaaaagaaataaaacacacattttggatgacagtaaaattagatgtcatggacttcactctccaaaagagcaaaatcatttgtccaactatctcaacaaaagatattcaaaaattaatggttagtgagtttatttaaactggaaaaatgtagctggccacaaattatactatgagcccacgtatgtagactccacacttgcattagtttctgaacaggtgtctactccaaaccaagcacagctttttgaaagcaagaagcatcaaaagtcttcattataggatttcaggtattttcccaagaggcacaaggaccttcatgctcatagcctagaaccttccttctctcaaaatggctagtttttccagtttaaaaacaaacaaacaaaaacccccacaaaacctgcaaacttaaaaaattatagatgcatagtgaaaaccaagagggatgacacagcagtgatgacactttcgtgctgacatgcattagacacctgtcataatggaaaataaaaattacatgacatttccctgggttattattggtgctatttcaaaactaccagctttgataacagaaagaaaacagttgggttctgccaggcttcaagttaagtcactttcatagaacagaaacatgaccatgatccagaaggtccaaaag

SEQ ID NO: 347740 - DNA, 503 bp, Homo sapiens
ctggggctgccccacgtgccatcactgcagcatgtaggcaggaacacaaacatggctgtctcctcgcagggactatcaggacccctagaatgctcacgttgagctggattatttcagggggagtcttggttacctgaaggcttccccaagatctgagctacctggtcagaggttcctaagtcagaggtttcaagctatgatcttgaaaccgctttggaggccactgccaggaaaggggacaccctcccaacacacacacccctgcctcaacccaaccaatcctgtttgaatttactggtcatctaagtgagagttctccatataattttctttggagaaagccttttgggattaaaaaataccgttttaaaacctcattcaaaattttgtcccatttcactgatacttgcgcactttatagctgacagagtgttttttacctgtatattttatcttacatattattaacttcatttttactcacaaggagactgaggcccaga

SEQ ID NO: 347741 - DNA, 580 bp, Homo sapiens
tgattgcacaagtctgttggtgtatgtttaatgctccacttgaggaatgtagaaggaaatgtttcgcgagtgaagtatataggtagtttatagtatagaatgccttgatatcgtatagaatgccttgaatcccatacaatagaatcatataattactcattttgtaagtaaacttctgagaattgtcttcgtaacagcataacataatctgagaggtcatcggtttattgggctacataagtcacatctaagtaatggattctcattactagccttgctaactcagaagataaatgggaaatcaagaaatggactaattttgttctgtatttcaataaaccacttccagaaataagggattaaggcaactggaatacatttttaaaccatacccttattaaacatctgtattttagataaaaattatattccttgaatataaaaaatcctcctatattgtttcaattaacaattctttggaaatactgattctatggttacttgcatcacacaaatctaatcttatttgaagccctgcattagctgaagtgaattcaaatctgttcagtaaatatttaat

SEQ ID NO: 347742 - DNA, 443 bp, Homo sapiens
tttgcagctattgtaaaaggggttgggttcttgatttctcagcttggttgctgttggcatatagcagggctactgatttatgtactttactttacttttgtatcctgaaactttgctgaattgatttaccagttctaggagctttttggatgagtctttaaggttttctaggtatacgatcatgtcatcagcaaacagcgacagttttacttcttctttactgatctggatgccctttctttctcttgtctgattgctctggctaggaccatgttcagcttttcacaaactatttaggattaattttgtgtcccactacataaaatattaaaaccttgcaaccatatatgctttatagttgtcatgttatttatgtatgttcagcctcacatacactgtgatattttttctttgaacaatcatatgtatttttttaaagttaa

SEQ ID NO: 347743 - DNA, 679 bp, Homo sapiens
cacctgtaagtattatactgcatttcttgaagactttgtcatatttgtacttgcagagttcttttaacagtttcacaatactccacaacatggaggttaagatggtccctgacttaacagtggttcaacatatgatttctcgactttacgatgatgtaaaaattatacacgttctgtacaaattgtacttcaagtacccatacatgcattctattttccactttcagtacaatattcaataaattacatgtgatattcaccattttattataaaacagactttgtgttagttgattttgcccaactgtaggctaacgtaagtgttctgagcacatttaaggtaggcaaggctaagctatgaagtttggtaggctaagtatattaaatgcattttagagttacagtattttcaacttatgatgggtttaccaggacatacccccatgtaagtcaaggagcatctgtactgtaatttattaaccatccaccatttgtggacattgctttttgtaattataataaataagacgtcaataaataacttaagtcactctgcactcatgtatatattatgggataaatatcttgaaataaaactgggaaatctaagttatatttatttcacatttcgatagatactgccaaattgtcttccaaaaacattcaatgtactctccca

SEQ ID NO: 347744 - DNA, 1027 bp, Homo sapiens
tttggtcaaatgaggtgaaggggaaaaaaaatgatgatcaaacttcacttttttccaaatagatgattttccaagtttctctactgaggatagaaatgttctctgcagttttgtaatgtttctttgagagagagaaggtgtgtgtgtgtgtgtgtgtgtgtgtgtgtgtgtgtgtgtgtaggaattatcagtatagcacagtagcttttatgcaagttctgaagtcacattggatttataactggctttaccacttactagtgcatcaccttgaacaaatgatctctgtatgcccacattttctaagtgtaaagcatggataacaataatgtcagcttcactatgatgtgaaaatggcataaactaagcacacaaggaacctagagagcactagctcacctgctgagttaatggacccaatcaagcaatcctggattctaatctctagatttggctgtgggaaaagggagctccttataacccacaactgaaattcagcatctctgccctgtggctttcaatttggggaggctcatatcgggtcttttcttaccctctgtcgacctcagctttaggattttgagtggattactgatctccttttaaggtgttcccttaggatagactgaactttgcataaatcataaaagacaacattttaagttcatcatcctgaacatcccttcaaatatggtgaaaattttagcagtatttatcctgtctcttgattcttggaccagtaacataatgttttaatttttgatcatataatttaaaaaataaatctaacaggttaaatatgtgctccctcccacacacactccccctattcattaatgtttaattagttattcttttcctgtgttttgacaggtgattacacataaagtagaaagataatgttagaaacatatcattttaaaccacagtccaaaaattcacttggtttatagacatttgtgtttcacacagcagtaatatttcttagttagagggttgcttttttcctttttttctcctctttctc

SEQ ID NO: 347745 - DNA, 973 bp, Homo sapiens
tttggtcaaatgaggtgaaggggaaaaaaaatgatgatcaaacttcacttttttccaaatagatgattttccaagtttctctactgaggatagaaatgttctctgcagttttgtaatgtttctttgagagagagaaggtgtgtgtgtgtgtgtgtgtgtgtgtgtgtgtgtgtgtgtgtaggaattatcagtatagcacagtagcttttatgcaagttctgaagtcacattggatttataactggctttaccacttactagtgcatcaccttgaacaaatgatctctgtatgcccacattttctaagtgtaaagcatggataacaataatgtcagcttcactatgatgtgaaaatggcataaactaagcacacaaggaacctagagagcactagctcacctgctgagttaatggacccaatcaagcaatcctggattctaatctctagatttggctgtgggaaaagggagctccttataacccacaactgaaatcttaccctctgtcgacctcagctttaggattttgagtggattactgatctccttttaaggtgttcccttaggatagactgaactttgcataaatcataaaagacaacattttaagttcatcatcctgaacatcccttcaaatatggtgaaaattttagcagtatttatcctgtctcttgattcttggaccagtaacataatgttttaatttttgatcatataatttaaaaaataaatctaacaggttaaatatgtgctccctcccacacacactccccctattcattaatgtttaattagttattcttttcctgtgttttgacaggtgattacacataaagtagaaagataatgttagaaacatatcattttaaaccacagtccaaaaattcacttggtttatagacatttgtgtttcacacagcagtaatatttcttagttagagggttgcttttttcctttttttctcctctttctc

SEQ ID NO: 347746 - DNA, 665 bp, Homo sapiens
cctctggggaaaatggttacaaccaagagtctatagaaaaggcctgtagtgttatagactgtgattagatcctaaagtcgttgttactcttgtccctccaaatcatggcaaagaccaaggataatggcttccatttattgcgtgcttattgtgagtaggtaagcacaattactgtataaggtatagtaatgattaaaataattattggaagctgattagaaaagtttaggtatcctgcccagagtcatgtggtcagtctagtgaaattggccaacttgaaatttgactgcagagtctgagctttgaactactgtacaacactgcttcccacataaaggagttccactgcccttaatataatcctgatcttacctagataaattacctctctaattcaaatagatctcagtgtgttgttaggattaaattgagataatatatgagaaatgtcccagctcagtgtctaatacatggtaatagtctctcaataggatgtttcccaaatatttatttctgaagtgcacccaaatctctgtagttttagtttttgcccttaagctttggttggaattaaattactttctgatatctcctcctgttatctaatggatgctgctagtctttttccaccagggatcagagcgataatttgcccttaaaaaaaa

SEQ ID NO: 347747 - DNA, 328 bp, Homo sapiens
aagatacaatgtgattcagtgcaatcccaaacataatcaaaactgtattttttggtagaaactgactggaaaatcaaaggacctattatatccaaagtaatccttaaaaggaacaaatttggaagacttcaactacctgatttacagacttaccaaagttacagtaatcatgatattgtggcactggcataaggctcaccaaataaatcaatgaattaggaacaagagatcagacattgagccacacttatatagtcatttgattttagacaaggatgctaaagtaatccatcagagaaaggaagttttttcaacaaatgatgatata

SEQ ID NO: 347748 - DNA, 315 bp, Homo sapiens
atgtggaggtctctcaaaatccaggaggggaaagattcctgaattatttaaatactaaccaagctaagggtgcttcacaagaggataagagcagcttgggggctttgcatcaatatggacacctgtgtacagccaggcagcccagtgcactgggttgagtcacagccttagaatctgggagcttgacaccatgctctctaaagcctttgacactgtttattgagaggctgggtctaggttgtctcctcttgaatatgggctttgtgatgcttgactaatagaagatgatagaaatgatgccatgctagttagtgg

SEQ ID NO: 347749 - DNA, 447 bp, Homo sapiens
ctaatagtctacagtctatataattaatttcctctctccaatctactcagatatttctacaattttaatttaaagatgaagttagaaggccgggtgcggtggctcatgcctgtaatcccagcactttggaaggctgaggtgagagaattgcttcagctcaggagtttgaaaccagcctgggcaaaaaagtgaaactgtctctaaaacaaataaggctaggagcacaaaagggctttgtattgatttctggccacggtaactaggccaagaaagaaattctatcctcctgcagaccagcaacaaccacagccaaggaatgctcctccggcatttgccatccacttgttaaaatgattaaactaggactgcatcatggtgggatgaccagcacacttcaaagggaaaaaaattttaaatcggaagatgaaacagttttaaaaatcactt

SEQ ID NO: 347750 - DNA, 770 bp, Homo sapiens
cacgtgacaggaccgagcgatgggaggattctggtgcaccccggaaggaggatttttaattcttctgttttcttgtctatcgcaaaacagagtttacatgtattttccttttttcttagcttaagaattgaagactttggccggattagacctggttgtgtggagaggagaattaataactacagtggagcgagccctcctgcgagagtcaggatactactatgctagtcccgactctgccccaaatgcctggagagactttggctaagtcactttttctttccgcgggctgtttaccgttggtaaaaggagagggtcacccactcactccacaaacatttgttgagtcattggttatagcgggaacaagacaggcaaagttcttcctgaattctggtcggagatggataacggaaacaactttgttgagggtctcgttctgtcgccctggccggagtgcagtgtcatgatcagggctcgacctcccgggctcaaacaatccccctacttcagccacccaagtagctaggaccacaggctaggagcacaaaagggctttgtattgatttctggccacggtaactaggccaagaaagaaattctatcctcctgcagaccagcaacaaccacagccaaggaatgctcctccggcatttgccatccacttgttaaaatgattaaactaggactgcatcatggtgggatgaccagcacacttcaaagggaaaaaaattttaaatcggaagatgaaacagttttaaaaatcactt

SEQ ID NO: 347751 - DNA, 716 bp, Homo sapiens
cacgtgacaggaccgagcgatgggaggattctggtgcaccccggaaggaggatttttaattcttctgttttcttgtctatcgcaaaacagagtttacatgtattttccttttttcttagcttaagaattgaagactttggccggattagacctggttgtgtggagaggagaattaataactacagtggagcgagccctcctgcgagagtcaggatactactatgctagtcccgactctgccccaaatgcctggagagactttggctaagtcactttttctttccgcgggctgtttaccgttgatagcgggaacaagacaggcaaagttcttcctgaattctggtcggagatggataacggaaacaactttgttgagggtctcgttctgtcgccctggccggagtgcagtgtcatgatcagggctcgacctcccgggctcaaacaatccccctacttcagccacccaagtagctaggaccacaggctaggagcacaaaagggctttgtattgatttctggccacggtaactaggccaagaaagaaattctatcctcctgcagaccagcaacaaccacagccaaggaatgctcctccggcatttgccatccacttgttaaaatgattaaactaggactgcatcatggtgggatgaccagcacacttcaaagggaaaaaaattttaaatcggaagatgaaacagttttaaaaatcactt

SEQ ID NO: 347752 - DNA, 631 bp, Homo sapiens
taacacaaatctgttacgtgaattaaagacacacaaaggcatttttaccagtgtttggaagtttgtgaatagtaaaggggaacaggccaaaatttcatgcgttgaggatataagtaaaacagaaagtgcaaaaatgtaaactacacaaactcaatctcttgtggaacaattagaaaactaataatacattttactcttgaatgttgatattccactcgaagtttggttggttgctaagcttaaggataaacactatgaaaaatgtgaagacagaagggctggccaaacacagctgattcggcagcaaatcacacattaaatcacagtggcatgtgagtcggtttattcaaattgctgttaaaagatattcttagagtaagtttaggaaaataagagtcatttggcgatgcagagaggattttgtctacagtggaatccagactccggtgaaagttctcattccttcaggacctgggagctaacagctccggactttcttgtgctccactgtgctgcctatgttgtgtgcttcccaaatggccattattcccaccagctcttcacagagtgagttctgcccattctgtagaagaaacagtagcggaaaaattaaacaatatctttgctcaac

SEQ ID NO: 347753 - DNA, 643 bp, Homo sapiens
taacacaaatctgttacgtgaattaaagacacacaaaggcatttttaccagtgtttggaagtttgtgaatagtaaaggggaacaggccaaaatttcatgcgttgaggatataagtaaaacagaaagtgcaaaaatgtaaactacacaaactcaatctcttgtggaacaattagaaaactaataatacattttactcttgaatgttgatattccactcgaagtttggttggttgctaagcttaaggataaacactatgaaaaatgtgaagacagaagggctggccaaacacagctgattcggcagcaaatcacacattaaatcacagtggcatgtgagtcggtttattcaaattgctgttaaaagatattcttagagtaagtttaggaaaataagagtcatttggcgatgcagagaggattttgtctacagtggaatccagactccggtgaaagttctcattccttcaggacctgggagctaacagctccggactttcttgtgctccactgtgctgcctatgttgtgtgcttcccaaatggccattattcccaccagctcttcacagagtgagttctgttccctcacaaggtccttttgtttatttctcaccgcgtagaagcacaaaagaatctaacatcaaat

SEQ ID NO: 347754 - DNA, 682 bp, Homo sapiens
cagtactccagcatgagcaacgcagtgataccctgtctctaaaaaaaaagccaaacgaaatttttttttttggggatagtgtctcactatgttgcccaggctggtaggtttctaactcctgtgctcaagcaatcctcctgccttggcctcccaaagtgctgggattacaagcatgagccactgtgcctggccaagaaaaaaataaaaatttaaaataaaagtaaagacaaaatattaaaaaatgttaaaaagtgattacataaagattaattggtgtttaataaaataaacattgctgaattaagaatcaggcttcaattctttgtacaagtatacatacatagggagtgaaagcaagaattcaggatttcactttacagcactgtctctcggactttaagatacaatctctgggaacaaaagggaccaaaatcaaaggtctacctgcacaatacctaaatatgaaagccccttaacttgacttagtgtccatactcctgcacatgcaatacttaaagcaacttaaaaaaaaaatcagatactgtgctatatatacttaacaaatacagactgctctacaagaacagtgatagaactttaagaaacactgcattatcgaaaatcacatataaaaataactggttccatataaaatgggaactgggggggacaagggagtttc

SEQ ID NO: 347755 - DNA, 1302 bp, Homo sapiens
gctggactgcaatggtgcgatctggtgtcactacaacgtctgcctcctgggttcaagtgattctcctgcctcagcctaccaagtagttgggattacaggtgccctccaccactcctggctaggtttttgcattgtcagtagagacaggctctcactgtgttggccaggctggtctcaaactactgacttctggtgatctgcccacctcgacctcccaaagtgctgggattacaggcgtgagccaccgtgcctgaccactcatgtattcttgattgaaacaatttgcttatgtcttagttgtacacctgaccttctttccctgtttccaaggtcaatagctatgtgttcacaactctgcattttataaatgttactgtgattttcttgtaaggaagaacaaactgtcaggagtcaatggcctcagaaccttgcaaaagaagtttgtttcttttttttcttttcttttttttttttggagacggagtttcgctcttgtcccccaggcttgagtgcagtggcacgatctcggctcactgcaacctccgtctcccgggttcaagtgattctccttccttagcctcccaagtacctgggattagaggcatgcactaccactcctagctaattttgtatttttatagagacggggtttctccgtgttggtcaggctggcctcaaactcctgacctcaggtgatccacccgcctcagcctcccaaagtgctgggattacaggcttgagccaccgtgcccggcaaaagaaatttctttagcccaggtttgtgaaagagccttctctaattttccaggatgggggtgataagatcaacccttcccattagtccctgcaggcccccatgtaagaattcaggcacacctcactcatctcagaccttctcagggcaacttggtgaaaatgtcttccaatctgagccccagtgagcctccttggaacttggcgatgaggggctacaccagaaaagctcaaccctagtgactttgacccctgaaatgattgacaaaatggagtgcgtgtgtgggtgtggcttttttttaaaatttttttgaggagaggagtgcccagttgtgattagaattttcaatgggatgcagtgccctaaaaatgaaaaacaaaagcagaagaatggaagaaacagaggtagactcagacacagagaccatcttcggggcctttctctgtatgaggacatcacaacaaaatctaaagcaggtcatgtcagtccctgacagggaaccctccaccagcttcccgtgttccccaggacaaaagcccaacccctca

SEQ ID NO: 347756 - DNA, 186 bp, Homo sapiens
tccagcctcctcctgggagcttgccctcatctcatgactctctccgccccagtcatatttgcttttctcttttcccaaacatcaaaacccttcctgtctcaggtcgttgtccgggcgtgcccggcaaaagaaatttcttagcccaggtttggaaagagccttctctattttccgggtaccaggctc

SEQ ID NO: 347757 - DNA, 698 bp, Homo sapiens
ggtgataagatcaacccttcccattagtccctgcaggcccccatgtaagaattcaggcacacctcactcatctcagaccttctcagggcaacttggtgaaaatgtcttccaatctgagccccagtgagcctccttggaacttggcgatgaggggctacaccagaaaagctcaaccctagtgactttgacccctgaaatgattgacaaaatggagtgcgtgtgtgggtgtggcttttttttaaaatttttttgaggagaggagtgcccagttgtgattagaattttcaatgggatgcagtgccctaaaaatgaaaaacaaaagcagaagaatggaagaaacagaggtagactcagacacagagaccatcttcggggcctttctctgtatgaggacatcacaacaaaatctaaagcaggtcatgtcagtccctgacagggaaccctccaccagcttcccgtgttccccaggacaaaagcccaacccctcactgtggctccacagccctgtgtccagggccccttccactgtccagcctcctcctgggagcttgccctcatctcatgactctctccgccccagtcatatttgcttttctcttttcccaaacatcaaaacccttcctgtctcaggtcgttgtccctggttttaccctacgtaccctgtcactttctcctccttcaggtctaggctcagagct

SEQ ID NO: 347758 - DNA, 619 bp, Homo sapiens
tcctgctctcactgtgggttcctgctcactctgtctccaggacagactgccttccgggcagccttccctcctcaagcctcttggcctttgcaatcctcttacctgggtcactggtgggatctcatttgtggatcaagtcgcccccagtggagacaaatgtctgatggagtctggccaaggccctcctgagccttcactgggccctgcatgagaagcctgccaaggctgaggggccagggaaacggagacgaagccctcagagcaggccaagagggtgggaggtggggggcatttagagggttagatacagagcacccctttacaaataccagctactggcttttcgtattacatgttcattttagatacaacatactgcacacgctcccttaacgtgtgtttacgcgtgggtggtgtatccttccagacgtcttcctcacatctatacataatatgcatagataaaacatttaccaccaaaacccatagtgttatgtacatatttgtctggctgtgtaactttaaataacatacaaatgtatagaacagaagcttgccctctttctgaaatatctaacgtgggatttcaggctttctgatgagacctctgtagaggtca

SEQ ID NO: 347759 - DNA, 3237 bp, Homo sapiens
  misc_feature (2568)..(2568): n is a, c, g, or t
  misc_feature (2634)..(2634): n is a, c, g, or t
ctagtcatcctcaggccatgcagtggaattccacagccttccaccaagctctgcaagatcccagagtcaggggcctgtattttcctgctggtggctccagttcaggaacagtaaaccctgctcagaatattgcctctcacatctcgtcaatctcctcgaggactggggaccctgcaccgaacatggagaacattacatcaggattcctaggacccctgctcgtgttacaggcggggtttttcttgttgacaagaatcctcacaataccacagagtctagactcgtggtggacttctctcaattttctagggggatcacccgtgtgtcttggccaaaattcgcagtccccaacctccaatcactcaccaacctcctgtcctccaatttgtcctggttatcgctggatgtgtctgcggcgttttatcatattcctcttcatcctgctgctatgcctcatcttcttattggttcttctggactatcaaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaacagtagagactccaggccaccagcacctccctctgtccctgtcccctctccagctgtttcctccatggagctcttcagcaatggaggaaatagggtttggggtcactttgttgtgcgtcttggggatgaggtggcttttcccagatggcccttgctggagagggactgggacacggctctcagtccatcagcncaactctaggctgctgctgcggagggagaagttgagcttcctagctccagaatcacaagcacccangagagcacagacctgtgtaagacaggaaagcagaacctgccatcgctcctggggcgcgccttcctttctgaaatgaactggctggatggagaaaacagactcaaatgttctggcccgggtgcctggcactccccacccccgccccccaccggccctatttgaactttatattgcagtcagcttggtgctttccgaaatgccattagccatcaggaaacccttgtagttggtgccttgccagccagaacctctgggacccacggacctgcaaagaggccgagtggaaaggtgggggccggcgcagggatttcaggatgaggtgaaagcgattcagtgcgcgtctgcccttggccactagggggcagctggcggccttccctgctgttgtcttcctgcagggtgagaggagcaggagccgagctccacccccacgccagccttgggcccggcctgggatcactgctgggaacgtgagagtgaagggaggacgcctaccccagcttaacttgtagaaatggccccagatcactgatggctgttccctgccccttcccttcaaaacacaacgcataaagcagtaatactaattaatactgaacgctc

SEQ ID NO: 347760 - DNA, 2208 bp, Homo sapiens
cgcggtgacctcacggcggtgtgacgtacccatggcgacgacaccacgattcacggcaggtgttcgagttgcccttcccgccagccactcacctgtccccgtcttccacgccctgagggccgcggctctggaaacggggatacaggagcctggcggcgccgaagcacccgcgcaggccaagacggctccccaggccaagacggctccccaggccgcacacagccatgagccaggctgcttgacgggacctgaccccgccaggttcccgtccagtccgcggggtgactccacccacagctggccgcgccaccgctcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaaca

SEQ ID NO: 347761 - DNA, 2495 bp, Homo sapiens
ctagtcatcctcaggccatgcagtggaattccacagccttccaccaagctctgcaagatcccagagtcaggggcctgtattttcctgctggtggctccagttcaggaacagtaaaccctgctcagaatattgcctctcacatctcgtcaatctcctcgaggactggggaccctgcaccgaacatggagaacattacatcaggattcctaggacccctgctcgtgttacaggcggggtttttcttgttgacaagaatcctcacaataccacagagtctagactcgtggtggacttctctcaattttctagggggatcacccgtgtgtcttggccaaaattcgcagtccccaacctccaatcactcaccaacctcctgtcctccaatttgtcctggttatcgctggatgtgtctgcggcgttttatcatattcctcttcatcctgctgctatgcctcatcttcttattggttcttctggactatcaaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggggtctcactctgttatgcagcctggagtacagtggtgcgaccacagctcactgtttcttcaacctcctgggctcaagcgatcctcctgcctcagccttctgagtagctgggaccacagagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaaca

SEQ ID NO: 347762 - DNA, 2404 bp, Homo sapiens
ctagtcatcctcaggccatgcagtggaattccacagccttccaccaagctctgcaagatcccagagtcaggggcctgtattttcctgctggtggctccagttcaggaacagtaaaccctgctcagaatattgcctctcacatctcgtcaatctcctcgaggactggggaccctgcaccgaacatggagaacattacatcaggattcctaggacccctgctcgtgttacaggcggggtttttcttgttgacaagaatcctcacaataccacagagtctagactcgtggtggacttctctcaattttctagggggatcacccgtgtgtcttggccaaaattcgcagtccccaacctccaatcactcaccaacctcctgtcctccaatttgtcctggttatcgctggatgtgtctgcggcgttttatcatattcctcttcatcctgctgctatgcctcatcttcttattggttcttctggactatcaaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggggtctcactctgttatgcagcctggagtacagtggtgcgaccacagctcactgtttcttcaacctcctgggctcaagcgatcctcctgcctcagccttctgagtagctgggaccacagagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaaca

SEQ ID NO: 347763 - DNA, 1498 bp, Homo sapiens
ctccccttgaggcacgggcgctctgggttgtgggagttggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctgggtggaccaaggaggatttggagctaattaacaagtgggccttccaaggggagagaatgattcacgggaacccctccggagtggacaatgctgtcagcacctgggtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaaca

SEQ ID NO: 347764 - DNA, 1091 bp, Homo sapiens
ctccccttgaggcacgggcgctctgggttgtgggagttggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaaca

SEQ ID NO: 347765 - DNA, 1642 bp, Homo sapiens
ctagtcatcctcaggccatgcagtggaattccacagccttccaccaagctctgcaagatcccagagtcaggggcctgtattttcctgctggtggctccagttcaggaacagtaaaccctgctcagaatattgcctctcacatctcgtcaatctcctcgaggactggggaccctgcaccgaacatggagaacattacatcaggattcctaggacccctgctcgtgttacaggcggggtttttcttgttgacaagaatcctcacaataccacagagtctagactcgtggtggacttctctcaattttctagggggatcacccgtgtgtcttggccaaaattcgcagtccccaacctccaatcactcaccaacctcctgtcctccaatttgtcctggttatcgctggatgtgtctgcggcgttttatcatattcctcttcatcctgctgctatgcctcatcttcttattggttcttctggactatcaaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccattcttggagaatcaggggaggagaccaactgttctggcagagagccacgactgtactggggagaagccccccttgga

SEQ ID NO: 347766 - DNA, 699 bp, Homo sapiens
tcacagcaagctgactggcgcaggcggtggtggctgtggcatcacactcctcaagccaggtatcccgggggtaggtgggccaggctgccagcctgggctcctaagaggggtccacctggagaattcccttgaaaggaaaaagagacctggaaacaggtctcagctccgctgtgtggccttgggcaagttagttaacctctggtctttgcttcctcattggtaaaataaggatgagagtatctagcttgcaagatcgttgcccagattcaagcaggaaagtgcacctagagagcctggtgcagggctgggctgtggctggggctcctgtcatcggggctgtccgcacaagcttgggaagtaaccagggcattgtcactctccacgtctgcctaaccttgccccacttgtacccttgatgtggtcaggatgcggttgattttgctacaaaacgaaagggtttccttcccgttggtttggggaaagaggaagaccgagtaatgggcttggcttaggaagctccctggtgcctgggggcctggcaaggggcttctgctagtgtttaaccacctgacacctacctctgccctcaggctcgctcctggcctacagtaggcactaaccggtcccacctgcctccatttccctctgtgctccttgtcccctccttccttccttctttctctttctgtctttatctcc

SEQ ID NO: 347767 - DNA, 1990 bp, Homo sapiens
ctccccttgaggcacgggcgctctgggttgtgggagttggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaaca

SEQ ID NO: 347768 - DNA, 2406 bp, Homo sapiens
atgttcatcttttgtaaagttaaaaaaaaaaaaaaaagccagcctccaaggctgagaatcgatattaatttcatgggcttatgggcagtgagataaagcaggtttctggcagccctttccagccctattggattttacaatcttgaactgtgaagacagcgaataaaggtatcaagggctctgcccgtctccagctgtctcgggccagagctcatccaaatcccccaccttccatcccagcctgcagccctctgaaaggcaggttggatggcaagaaatgtcagcttgagccctcgaagacggctcactacaaggacagttgggattgtggctttaggagggatttatgcagctcctctggggcaggtgaggaccacggggtcatgctagagagtcagctcaacgtggctgcctgggacacgtctatgtgccagagggcagccaaggggatgactgactctacatctggttttagaccagggctgctcgtccgggcaccattgaggtagggcaagaatgggctcagcgtgctggggaccatcctcctctgcaaccctgccctccctgcatttacgagcccgtgcgtggcactgcccgcaccagctagcctgggcatcttccctctgtgtgatccatttcagggcctgttgcttggtctttctaaaactccagcttcgtgggggtgacccacacaagtgaaccttcgccccctccttgtactctgctatagccactttgaatttctcactggatgactgtgccgggttccgccacctccaggctcacacaggctgctccaactgccagaaatcctcacccttctagctttgcttggtggcttcttacccttcctcagttctcagtgtccacgtcatgccagaaaaaccttctcggcccttctcccctatcccctctctggccccggccccaaggccacgctgtgcctagcatgttgtaggtcccagttgaagttgaatgaataaatgagtgaaaagccaagggagaatggccacccaaccagtgcctgggatggaggcgcagctgtggccagcagcagaagccccatgctcccccaatccagtgtcacctcttgtgcctcccttcttcctccgtatcagggtgggcggcttcccggactgctcccagtcctgtcccagctcctccatcttgagttcagtgtggacctgcctcctcttcaccctgcaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaaca

SEQ ID NO: 347769 - DNA, 1689 bp, Homo sapiens
ctccccttgaggcacgggcgctctgggttgtgggagttggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctgggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaaca

SEQ ID NO: 347770 - DNA, 2232 bp, Homo sapiens
ctagtcatcctcaggccatgcagtggaattccacagccttccaccaagctctgcaagatcccagagtcaggggcctgtattttcctgctggtggctccagttcaggaacagtaaaccctgctcagaatattgcctctcacatctcgtcaatctcctcgaggactggggaccctgcaccgaacatggagaacattacatcaggattcctaggacccctgctcgtgttacaggcggggtttttcttgttgacaagaatcctcacaataccacagagtctagactcgtggtggacttctctcaattttctagggggatcacccgtgtgtcttggccaaaattcgcagtccccaacctccaatcactcaccaacctcctgtcctccaatttgtcctggttatcgctggatgtgtctgcggcgttttatcatattcctcttcatcctgctgctatgcctcatcttcttattggttcttctggactatcaaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtcgccagctctccagatcctgctgaccaacaccaaagtccctcgcaataccagggcccttgtggctggcgtcagaaacaggctgctcaagttcccagagatcgtggcccccctcctgacctcaatagatgccatctccctggagtgtgagcgcgtgctgggagagatgggggaagccccagccccggagcagtacctcgtgctggaagagctcattgacatgaaccagcaccatctgaatgccctcggcgtgggccacgcctctctggaccagctctgccaggtgaccagggcccgcggacttcacagcaagctgactggcgcaggcggtggtggctgtggcatcacactcctcaagccagggctggagcagccagaagtggaggccacgaagcaggccctgaccagctgtggctttgactgcttggaaaccagcatcggtgcccccggcgtctccatccactcagccacctccctggacagccgagtccagcaagccctggatggcctctgagaggagcccacgacactgcagccccacccagatgcccctttctggattattctgggggctgcagttcgactctgtgctggccagcgagcgcccagctcctgacactgctggagaggccccagccgcttggcgatgccagccaagctctgcagtcccagcggtgggacctagggaggcatggtctgccctctgcatcctctggagccagccgagcaggaggcctaggagggtcctctgagactccagacctgaggcgagaagggctgcttccctgaagctcccacagtcccatctgcttcaggcccccgccttggcctgtgttcttcctggccgcctgggtccaatgctcaggtgctggggcctggttcccggagaagtgtgccttctctctcccttttcagggaccgccccctgtctctcagggccaggcctctccctcctccaggaagccttcccctaccccttgtcgcccctccctcccagagcacctgctgtctgggtggctcactcagcacttggtgtggccttcccttctacctagcgggatggggctcccccaggggctgtcccggaggcggtgggcctggttaaataaggcagggtttatatgcactttcttccgatctgtacctgagaggtttgtggaaaagatggcaaatggggaataaaaagattttgtgtcaaca

SEQ ID NO: 347771 - DNA, 1101 bp, Homo sapiens
ctccccttgaggcacgggcgctctgggttgtgggagttggggagctgctccggcttcggcgcggaggggcggcggccggggaggcggcggcggcggcaggattcccaggagccatgttgtcagaagtcctactggtgtctgctccggggaaagtcatccttcatggagaacatgccgtggtacatggcaaggtagcactggctgtatccttgaacttgagaacattcctccggcttcaaccccacagcaatgggaaagtggacctcagcttacccaacattggtatcaagcgggcctgggatgtggccaggcttcagtcactggacacaagctttctggagcaaggtgatgtcacaacacccacctcagagcaagtggagaagctaaaggaggttgcaggcttgcctgacgactgtgctgtcaccgagcgcctggctgtgctggcctttctttacttatacctgtccatctgccggaagcagagggccctgccgagcctggatatcgtagtgtggtcggagctgccccccggggcgggcttgggctccagcgccgcctactcggtgtgtctggcagcagccctcctgactgtgtgcgaggagatcccaaacccgctgaaggacggggattgcgtcaacaggtggaccaaggaggatttggagctaattaacaagtgggccttccaaggggagagaatgattcacgggaacccctccggagtggacaatgctgtcagcacctggggaggagccctccgataccatcaagggaagatttcatccttaaagaggtaacctgggggtggagcagcacattcagccatggctgcattgatgtgtgcagggggcagagctctgcacctttgggaagtaccataggaggcaggtgtccctggctcttcatcccccaatgtggccctcacagtgcactagctgcaaggaagcaggggtggtggggaagacctgctctctccttctccccttcagctcttaaattgcagagatatcagaaagggaaagtcatgcatggctgtgcccgtagactctcagctgctcattcattcattcctgtatttgcttagtaaacaagaatccattactt

SEQ ID NO: 347772 - DNA, 210 bp, Homo sapiens
gttgtattctaggacaataccatatactcctctttcttgcagttttaaagttttgtatatttgcttccttttgtctttttcactagtttactgtccatcccaaccacgagggtgtcagcttcacaagggctgaagccctgtctgtctggttcattcttgtctccccaggacctagtgtaatgcctgccatacaacaggtgctgaataatt

SEQ ID NO: 347773 - DNA, 363 bp, Homo sapiens
tccccaaagatgtccatggccgaatccccagaacctgtgaatatgttgttttatgtggtaaaggggactttgcagatgtgataaaggatcttaagatgggagattattgtggattagtgtgtgggcccagtgtaatcacaaggatcctcatgggagagagacaggagaatcaggaaaaggagctgtgatggccaaagcagaggttggcgtgatgtgatctgaagatggaagaaggggccaggagccaggaagtacacgcggcctctggaagttagaaaaggcaaggaagtggattcttccctagagcctccagaacacgggtcggccaacaccttggttttagctcctaagacccattttaga

SEQ ID NO: 347774 - DNA, 446 bp, Homo sapiens
aaaaaaaaaaaaaagactgaagaatgaagtctgattgtatagggctttataggccattgtatagaactttagatggtccacttctccaaccctatcacccattagttgtttaatttaaaatagctgactctcttctcttcccttccccattttaagaatgtaagtctcctgggagtaaggacctaatctcttgtttactcctgtattttcagcacttgttacagttgcctagcacagagtaggccctcagtaaatacttgttaaaacaacaaatggggtatgtctccaagatcttaatctggttgaagaagtgctgttaggactgaaaacaatagtaaccatatgagaaagcttccaggaggatcctcattaagtattacttttccaagtcatcacagttgtgtgtgaaagcaaaagttgttagaatatgaaaatatttgttaatg

SEQ ID NO: 347775 - DNA, 280 bp, Homo sapiens
ctatgaaaagtgatgttttaattaattaaattctatggccatttatattctgactcttgcttttgaacatctttttaatatgtgtgtgtacactttccttgcttggtgagtacatcatttaaactttctttggtatttgaaaaaggccttgcagttatcctttgatcacatttgcaaattttcaccattactatttaatcaataaatgaattcattgcttgagcacctgctcagtgcatttcacattggactagttgctatggggacagagaggaagtaa

SEQ ID NO: 347776 - DNA, 1051 bp, Homo sapiens
  misc_feature (1051)..(1051): n is a, c, g, or t
gcggccgcggggctgcggctccccagccccgccagctggagcgctcggaggtagaggaaaggtcttgacggggtggctggatccgtggcagactcaaatccaggccaagtgtatggctgtctgaggtattggaacagaaggaggtccattcctgttggtgacaacaccgtggccctgttctgggatgagcaaggtgtaaaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaagtaaagtatcagtggccgggcattgaaaatgggctagtttattctttcattttcactttctttcttaggtagttgtttcttgaggattgactgttcagggcctgccggccctttacatctacgtcttcagaggttgcattttgtcagagaataatgtttgattgatttactgtgggctgacagaaaatacatttacactatgtttgcttttcacataaaattaaattcatagtgttaagccaagggtaatcatagcaacagtactgtcttgaatatatcaacagtgactttctttctgataatgtagagtagaatttacaataatccctccctaactataagttgttctttttggaactgggtatggaggttactccgatacttttgtaacgagactgactcgatttgaatctccggtcccaagtctccgcatttttctggagggctcacacagtgccaacttacggggccaaagcgtctggtgcccattttacacgggaacaggcaaatcaggcgggaccacatgcatagattattagatataaacataaattatagagagcgagaaatactcacccaccacccagacccacgaccgcccagatacaccaccacgaccacgcaccagcccacccacgccccccccgn

SEQ ID NO: 347777 - DNA, 719 bp, Homo sapiens
aaatatttcacatctgtcctatttgatttagttcttccaacacttacccaaggcaactaaggcaggccttttcacttgatactaagcaggcccagaatgatgaggtgactaacagcaattctcagcttgtaactcccaactcctgactcccacttccgtgccctttctggaatcctatgtaacaatgcctttttacacttcttagccctctgattttctagctttcttaagagatattctgaaattcaccagagagattgagaaagagagagagagagagtgtgtgtgtgtgtgtatgagagagagagtatgtgtgtgtgtgtgagagagagagagagagagagatgtttggtgggagttggatgagggagcagtagcaggtggggaaagaggttccctctcccctacaatgcttctctcagcaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggtgagtaatggagtccagggcagggagttagggatctccaaatccaggcaaatgctgcttttccaccagatctcccaatattggggaatttggcccagctgccttaatctcttgcctcctccatctctatatgggatgaccctgac

SEQ ID NO: 347778 - DNA, 487 bp, Homo sapiens
gcggccgcggggctgcggctccccagccccgccagctggagcgctcggaggtagaggaaaggtcttgacggggtggctggatccgtggcagcctcgagtctcctacgtggctccccggagccctgagaccaagcgagcagtttgcatgatcccagttcgcggacaagtgggtgtgtcagggccgttcccagagggccggggctccttcgcttggtcaaaccctagactcgtttactggggcctgggccgcttgaggcaaaacccgccttgaaagctacgtcagcctaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaagcatccccacccacgtaacccacct

SEQ ID NO: 347779 - DNA, 2736 bp, Homo sapiens
aaatatttcacatctgtcctatttgatttagttcttccaacacttacccaaggcaactaaggcaggccttttcacttgatactaagcaggcccagaatgatgaggtgactaacagcaattctcagcttgtaactcccaactcctgactcccacttccgtgccctttctggaatcctatgtaacaatgcctttttacacttcttagccctctgattttctagctttcttaagagatattctgaaattcaccagagagattgagaaagagagagagagagagtgtgtgtgtgtgtgtatgagagagagagtatgtgtgtgtgtgtgagagagagagagagagagagatgtttggtgggagttggatgagggagcagtagcaggtggggaaagaggttccctctcccctacaatgcttctctcagcaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaa

SEQ ID NO: 347780 - DNA, 1279 bp, Homo sapiens
ctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacagaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaagtaaagtatcagtggccgggcattgaaaatgggctagtttattctttcattttcactttctttcttaggtagttgtttcttgaggattgactgttcagggcctgccggccctttacatctacgtcttcagaggttgcattttgtcagagaataatgtttgattgatttactgtgggctgacagaaaatacatttacactatgtttgcttttcacataaaattaaattcatagtgttaagccaagggtaatcatagcaacagtactgtcttgaatatatcaacagtgactttctttctgataatgtagagtagaatttacaataatccctccctaactataagttgttctttttggaaatttgggtataggtaggtttacttctgtatacctttttgataactgaaaattttgaattcagtatatgagaatcagtccacgttgccacaatattgtctctctgactatattgtaagtgggaaggcatttctgagtcatttgtttccattatcattcttcaacctgttttcccctagacagccccatgtgtactgagtagcacaccaatatattataatttatccttctggtgtttgtaataccatttggtgcttaaatgtcatatgctaatgctttgtgacgtgcagggatatgaaatctctagtaagtaactttcagggtacattaattagcataaagcttgacatggcttctcagatatgaagcaagtac

SEQ ID NO: 347781 - DNA, 1222 bp, Homo sapiens
ctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacagaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcggtaagtgaaaaattgaaaactgtttcacatgattggtgtttccaaagatttaagagaatataactgcacagatccagtttttagatataaagtcttttaaaaacaattttaaggtataattcagtttatataaaattcacctattttcaggtaaacagttcaatgagttttggtaaatgtatatacctatgctaccatcaccacaattgagttttagaacaagtccatcaccccagtaaaatccttcatacctacttacagttaactccacccaccccaccctagtcacaggcaagaactaatatggaatctgcctttatggatttggctttctggacatttcatgtaaatgaaataatacagcgtgtgacttttgagga

SEQ ID NO: 347782 - DNA, 304 bp, Homo sapiens
aattacattttatttcaagtaaaatatattggtaacagcttgattgcttattcttttgataattttcaccttcacagggcatcaggtactgtttatacagcactagacattgcaacaggacaagaggtaagtgctaacgttcaatcctgatttttattttcttttattcatatttaacagttatcttcttcgatggcaacttcgcctaaaaaaaaaatgggtagcactgggttgacataggtgtttacttccttggtgcccaaagcctctgaagtgagtagtttacccatgataaccaaaaaat

SEQ ID NO: 347783 - DNA, 443 bp, Homo sapiens
tctgtgccaagccatgattttaatatgtatgtgctgaatggatttttctatttttttctacaggcattgtatctgatagccactaatggaactccagagctccagaatcctgagagactgtcagctgtattccgtgactttttaaatcgctgtcttgagatggatgtggataggcgaggatctgccaaggagcttttgcaggtgaaaataaaataggacaattacaaagagaggcattatactcagcttttccatctcaatgtgtgacagagagctctgtcaagagatgtctagagttaggctattaccattttattttagaccacaggcacataactataggcacgcatctaatacatgattgattgacgtgttgcctttcttctgagaagttggcagtgtaatctgtaaatctcttttgttcttcctggagtcttattttg

SEQ ID NO: 347784 - DNA, 2581 bp, Homo sapiens
gcggccgcggggctgcggctccccagccccgccagctggagcgctcggaggtagaggaaaggtcttgacggggtggctggatccgtggcagaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaagaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaa

SEQ ID NO: 347785 - DNA, 2510 bp, Homo sapiens
ctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacagaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagcaaaaaaagcaaggcaaa

SEQ ID NO: 347786 - DNA, 714 bp, Homo sapiens
tgagacagggtctcactctgtcccccaggctggagtgcaggggtgcaatctcagcttgctgcagcctcgacttcccgggttcaagcgattctcctgcctcagcctcccaagtagctgaggaggcgcgcactaccacacctggctaatttttgtatttttagtttcatcatgttgcccaagctggtctcaaactcctgatctcacgtcatccacctgcatcggcctcccaaagtgctgggattacaggccagccaccacatcgggccccatctccctacttctacctgccatcactgctgctctctgcaagcagtgcaccgggaaggggaggcctgcattgtgcactgctctccaccctgcaggtggccttgacacaggcacggggagggttggggtcacacaggtgccacatgttatccagccccatcctaaactagaacagccacagcaagctgagcacacagcttggcaggcacctctcacccacccccatccagatcctgagctcgccccagcacacagcttgccatttcccggaacctgcccatcctttgaaggttggggcagcagggccatgggaagggaggctttcccacgcccagccagagcccagcattttcattttgcactagtcctcgtaatcacatggccggccctgcctcttcctctaacagtctccccgcagcccttcacttgctagtcctttgatcattc

SEQ ID NO: 347787 - DNA, 741 bp, Homo sapiens
caggcgcctgccaccacacccagctaatttttgtatttttagtagaaacggggtttcaacatgttggccaggctggtcttgaactcctgacctcaggtgatccagccaccttggcctcccaaagaagagtttggatgagtttcacgtttgaaaagctcacttcactctggctgctgagcagcatggttgtgacagacataccgggaagtcagttgagggccatcctagttctgccaatctagctgtgcctcctaaaataactcatttagtgtctctgagcctcagtgtcctcatgatgggagtgggtgttctgtatgtttttttatgaggaagtgagaggccagtcacatctgaaatcagtgactacagggatctacaagaacagttggaaatgataggaccttccttagagctctatgaggattgaatgagtgaattccactgaaacagtgcctggcacagaataagtgcattctaaatgctggtgttggttattatcatgcaaacactgtaggagagcgatgctggaggtttggattggggtaatgacagcagagatggtaaaaaagtggcttgacttcctttactgaaagagagctgggttcagacacgggtgaggggtggtctctgcttttgtggaactggtggttcactgtgggagacgggtttgtaaacagataatcaccatgagatgcagtaaaagcaacagtggtgcttaattagccagattgttttgttttg

SEQ ID NO: 347788 - DNA, 364 bp, Homo sapiens
gctaacattctaatgtagaaaacttggccctttggaggactctgttgactacttgattttagggctgttcaattctcccacttttactgttcaccatatgtgtgttttttcattaaaaacaatgcaaattccttgagaggctgaggcaaggaattcgaaacctgcctaagcaacatggccagactctgtctctatgaaaaacaaaaatagcaaattagccaggcttggtggtgcatgcctgtagtcccagctattcgggaggctgaggtgggaggattgcttgagcctgggaggtcgagggttatagtgagctatgattgtgccactgcactacagcctgggcaatagagcaagactttgtcta

SEQ ID NO: 347789 - DNA, 825 bp, Homo sapiens
ttgctagataaccatcccaatccaggatccaagtgtgagaacaggcccttactcagtagctcagatctcaagatgactccggagtacactttttgcactaggccaattaagagagctgggagcaaactgactcataacctctagagacaaagaatcagacctttctggaatcccacagaatgtttttccaccaggctgttctagttagcattttgaaacagacattctactttagaactgaaggcctgacttcctcaagatattttgatagacgtgaacataagccaaagactcggccaaacttgagcatcctacataatgcatcaagctcaacagtaaaatgcctccttcacagcacagcgtgggtggtggaggacaggctgcaagctgccactgtaaaccactaaaccagggacaaagtggttaacccaacaagatgcattaccaccactgtctagatagactgcaaagtttaaagaaaaaaggatccatatgtaatgggacataacaaaccactatccatacaagataggagaacacggccctgcctgaaaattgggtttgagtcaggattacatatgccaggtacttggctaagctctgagaatataaaggcaacatgggccctgtctgtatctaggagagaaaaagaaacgtgtaaacactgcagtcaaataaagcactaccagggctctgatgcaaatctagcccagatattctccttggaggccctaatgcttcagtcatgtttttaaaaaaagaatagggatttgccaggcattgcaatccgcttgacagtgagcggttgcaatccgcttgacagtg

SEQ ID NO: 347790 - DNA, 306 bp, Homo sapiens
atgtttttaaaaaaagaatagggatttgccaggcattgcaggcagatggagcaggtagggtgttctgaagcagaaagagctattagggaaatgtaaggagttccacatagctaggaaggtgggaaggtaggcaaggggccaattttgaagggcactgtacactaacacagagtcacagtgttattaggctagtgcaaaagtaatcgcggtctttgccattacttttaatggcaaagaccgcgattacttttgcagcaacctaatagctctgggggaatgaggagcctttctatgatttgtcaagat

SEQ ID NO: 347791 - DNA, 339 bp, Homo sapiens
gacccagcaattccaccaccacatcgatgcccaagaggactgaaagcagctgctcaaagaaaaacttgtgcacgaatgttcacagcaatgatattccaatggccgagaggtggaaacagcccaagtgtcctccaatgaatgaatgaataagcaaaatgtggtctatccatatagcggaaaattactcagcaataaacagaagtgaagcgctgatacaggctacaacatgaatgcaccttgaaaacattctgccaagtgaaagaacccagacacaggccgggcatggtggctcatgcctgtaatcccagcacgtggggaggccgaggcgggtggatcacc

SEQ ID NO: 347792 - DNA, 581 bp, Homo sapiens
  misc_feature (14)..(15): n is a, c, g, or t
gtatctctaacatnntgcagaaggtataggggttagtccttgctatattatgcttggttataatttttcatctttcccttgcggtactatatctattgcgccaggtttcaatttctatcgctaagacccccgaaaccagacgagctacctaagaacagctaaaagagcacacccgtctatgtagcaaaatagtgggaagattctatggtagaggcgactgacctagcgtgcatgatgttattattggccgattaactagattacttctgaaccacatacgggcgagattcagtacatcacagaatggctgaggaacatccttgggtcgtgacgagagtagaaaccctagggagcagtgcttttgggtcctagaacctgttgagtttctaatgaatatttgtagaatctcataaaacagtttaaatacaagcttaagtggcttatgaatcctgtgaagctcatttatggactagtgtaaaacaatgtgaagctctactaagttctgtccttaatcataaataatagacccttgaggactagcctgttctctggtcaccttaccagttgggttgcacattgtg

SEQ ID NO: 347793 - DNA, 3437 bp, Homo sapiens
  misc_feature (1873)..(1873): n is a, c, g, or t
agcctcatgatatgccttgccagaagtagcgcctgagatggagatttgggtgcaggtgatttattgacgatgtgttcttcaggaaaaatactttctattcacatttttagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacntaaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagttttaaaagtttgct

SEQ ID NO: 347794 - DNA, 504 bp, Homo sapiens
ctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagaggtgagaagccccagtccatgtggggttgaggatggaggtgagagctatcaactgtggcacggttcattttcttaacgacagccacttgtggctatcactaagtattgtggaaaggcttctttgcctagaaatattcttccttaggctctgcctagaatctgaaattccagtatcatttgtaactttgggttaagaattaaagtctttagtaaaattct

SEQ ID NO: 347795 - DNA, 3613 bp, Homo sapiens
  misc_feature (2049)..(2049): n is a, c, g, or t
ctgctgatgttggagcagttcctggccatccttcctgaggagctgcaagcttggctgcgagagcatcggccagagaatggagaggaagctgtgactatgctggaggagctggaaaaagaactggaggagccaaggcaacaggacacaactcatggccaagaaatgttctggcaggaaatgacatccacaggagcactgaagtctctgtctctgaatagcccggtgcagcccttagagaaccagtgcaagactgagactcaggagtcccaggctttccaggagagagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacntaaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagttttaaaagtttgct

SEQ ID NO: 347796 - DNA, 562 bp, Homo sapiens
gaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaaatgttctggcaggaaatgacatccacaggagcactgaagtctctgtctctgaatagcccggtgcagcccttagagaaccagtgcaagactgagactcaggagtcccaggctttccaggagagaggtgagaagccccagtccatgtggggttgaggatggaggtgagagctatcaactgtggcacggttcattttcttaacgacagccacttgtggctatcactaagtattgtggaaaggcttctttgcctagaaatattcttccttaggctctgcctagaatctgaaattccagtatcatttgtaactttgggttaagaattaaagtctttagtaaaattct

SEQ ID NO: 347797 - DNA, 3671 bp, Homo sapiens
  misc_feature (2107)..(2107): n is a, c, g, or t
gaattcagaaggaatctctcagacgcaaatctccatctcctccctgcctcacctgggcagccttttcagactgtctctgcccagaatgtcaggagaggccacagtcttggcctaccatgctccagaagaacaggaaggacttctagttgtcaaggttgaagaagaaaattatgttttggaccaggactttggccttcaggaaaacccctggagccaagaaatgttctggcaggaaatgacatccacaggagcactgaagtctctgtctctgaatagcccggtgcagcccttagagaaccagtgcaagactgagactcaggagtcccaggctttccaggagagagatggcaggatggtggctggcaaagtgttgatggcaaagcaagaaattgttgaatgtgtagcctcagcagctatgatatcgccgggaaaacttcctggagaaacacattcccaacggatagctgaagaagctttgggaggtctggacaactctaagaagcaaaagggaaatgctgcagggaacaaaatcagtcagcttccttcccaggacagacatttcagtctggcaaccttcaacagaagaatccccacagaacacagtgtccttgaatctcatgagagtgaaggaagtttcagtatgaattcaaatgatattacacaacagagcgttgacactagggaaaagctctatgagtgctttgactgtgggaaggccttttgccagagctcaaagctgattagacatcagagaattcatactggagagagaccttatgcatgtaaagaatgtggcaaagccttcagtttgagctcagaccttgttagacatcagagaattcatagtggtgaaaaaccctatgaatgttgtgaatgtggaaaagccttcaggggcagttcagagctcatcaggcatcggagaatccacactggagagaagccttatgaatgtggagaatgtgggaaggccttcagccggagctcagcccttattcagcataagaaaattcacactggagataaaagctatgaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagacttcctggatatgatggtatctcagacntaaaggtgggtagaaggtagcaagggcaggggagaagagaacaggatctggagacactccatgaagactcttctctactgcagaaattgtcatagacctaatttttaaaaaaatgaatctgaaggagtaattcaacaaatatttattgccctcaagtataatagctcagggcctgcaagcctggtaaggaggggtgtgggcagggaatggggaatagcagagcctgggaaggcagatcaccgtgttcctttatacttcccactgcctgagtcccagagtcatgggacacaaacactccagtccccactgtctctctagcctctgatatgcattctttccctgtgtatatacatgccttttcccataaaatgcaccagtctctcaccacactaattctgagtacttcagagtctcacaggtcattctgggtctagaataggctccccaactcagtgattataagtaggaagaggaaaagcaacacatggggattctgagccaggctttatgacaactaattcctgctggagagaagagtcctgatgatgggctgtctccagatcctatcttatcttcatgccattgtatgggctataacctctgcctgtaactctctctgctaatttttattttggcagttttaattaacccacaattgctgagggcaattaatacctaaaagaaagtttgattcctcttctaagatatcctaggtagtgtcatttctaaagaagacttggtgatcactgcttgtattagtccattttcacagtgctatgaagatactacctgatactgggtaatttattaaaaaaaaaaaagaggtttaattgactgacagttctgcagggctggggaggcctcaggaaacttaaatcatggtggaaggcgaaggggaagcaagcaccttcttcacaaggtggcaagagagagtgcaggggaaatgctaggcacttatcaatcagccaaatctcatgagaattcactatcatgagaacaagggggaaatctgctcccatgatctaatcacctcccaccacgaccctccctcaacacctggggattactattggagatttgggtggggacacaagagccaaaccatatcactgctgttgtgggtaataggggaggtgaaattggggggacaattcggcctctttgtgtccagaggttgtgcagttatcgagtgaggtcgatcagaagtctaaagggatctttcaaatggatagtgagttgccttttcctataggtgacaatcagagatttaatgttttaagtatcatataataggtttttctcctgattgtgaattgtaagtgttggtaatacagaaaatgagaaagtataaaccacccccaatcccaatgcccatagaaacgttgttaacattttggagtactttctattagtgtttatttttcccaatcctagtatttttagtaaaactactgtttagtaaatgatttttggtaactaatttcaaaatttatacttcaaccgtttattattagaatgtaatgcaagatgtattgcaataaaacttgagttttaaaagtttgct

SEQ ID NO: 347798 - DNA, 1092 bp, Homo sapiens
caggttaaatgggtatttcaggaagaagtgccaggcctaggttatttgtagaataagactgtaaacagaactgccctgctgttctttataaaacattaggcttgcaatagatagggacttagttcccagacttagcaatctatatatactgtagtacatgcagcaacaaatggaatttaccattgaccttaaacaacttttgacctgtctcggtttgcaaataggggttaaaattaaacaagagtcgtaagtgagcataatttcttacttggctgctcgtacatggaattggagggaaggttttacaagttgtgaatgaattctgcatttatatctagctgggtgcagcctggtgccttgttttgaaggtgaagaaggcactgtgtgcagggcaagatgaaaatttgtctggtggagtcattaagaacttttcccccggttacaaacaaaacagttcagggcaaactgtgttctattgatttcagacagagagacgaccctgctgtgagaggcaaatcaatgctgtacttttatttgaaagagtcagtaaaacctaggaaatgccacctgaaatgcaaaatacctaggtcaagctgtgaacaaacacatctgaataaatagatggcagaaaaagcttattacttgatgttcaagtgctgcaaacaacagaatctctcatttctggaatccaataaaacttaagtcctaaagaggcagtttttgaactcaaaaacccatcaaagtgataaacgtgtacatgagtgacgcctcacctcatttaatgtaaggaaacctcatacatctcaatggtacaggtcccttgtaaaaggttgttttcaatctatgttcaatgtaggttagtcagctatttaatagttacgttattgtcataagctcacatggaagtatttctttgtctggaagatgttttatgaaatggtattttcttccctttttttctgccattggaagaaaactttaatgttattcacagttgccctagaaacaagaggcactgcgcaccacacagcgccacggtgggaagcacccgtgtcagtccagatgcagacaggggagggaaagacataagcc

SEQ ID NO: 347799 - DNA, 408 bp, Homo sapiens
cctcagttgatctgcccgcctcggcctctcaaaactgctgggattacaggcatgagccacaacgcccagccatatataaacttttcaaagcactgtgccttcaaagatgtgataattttcagaattttgaaattttaacaatattaagagaatacactgtgagggcagtgtgcatgacttggtactagttatgctggatagctctgctaggttgttttctgtgtctgttattggaatgaaagcaatggcataagggcatagagatgccaatttggatttgtccccaagtatctctttgctgtcatgagcagtgggaaataagaatttcaagtggaaaagagtgaagaagtgaaaccattttgaattaggccatttcccaaaagaatcttcctttttttttaaaaaaaa

SEQ ID NO: 347800 - DNA, 606 bp, Homo sapiens
tttcctgcacttctccttctcctaaccagtgactaaacattgttagttattgcttgtagtactgccatacaaattaagtgtcaggtttacctaggttccctcctaatccaaagagggagagtgaggcccctttaacaaggctggcagggataaatgaggcccacagggactggcctcaatcatatctcagagacccaaggacagactgatccatctgtcttactgaaagcacaagtttgatgcgtatcaaccttaaatactagttctcttctttctagaggaaattggcacatattgaaaggcaagcaattcagctatagcatacagacaaaccagagctactgtggcccttcactctgccttgttgttttctgcatgcactgtagaagaccaagccccaacttaagcaggcaatctgaaagcccaggagaaattaaaaacttctgttggtatacttgacaacagaacaatttaccccagctttatgcagtcattacacttggagcagctttttcaatacaaattcctttcagagtctagtaaaaaatttcattgttcaacagcagcattataggtttattatcaattataactatgtcaggtctt

SEQ ID NO: 347801 - DNA, 278 bp, Homo sapiens
gaatgggtatggcatatgcataagcccagtttggaaaggagcttggtgtacttaaggagcagaatggtgaccagggtcaagcatagtgaaagggaatgtaggatgagctgagtaagaggggcaggctgaagccaggtcatgcagggcctgtggccacaggaaagaagttggaagtgatcagcacacacaaggagaaggtgacccttaggagaggagattggagagggcaagaatggatgaagtgagttgaggcttagagtggtagcttgtgtcaggtg

SEQ ID NO: 347802 - DNA, 119 bp, Homo sapiens
acaagttactctgcaaaaagcaaaaccaggctaactgaagagacagctgcaaaacacacaatgatataatgtgtttgccgatctgcaaaatcatttgaaagttgctgcttcaacagctg

SEQ ID NO: 347803 - DNA, 462 bp, Homo sapiens
gagacagagtctcactcttttgcccaggctggagtcagtgttgtaatcactgctcacttggcagcctcgacctcctgggctcaagtgatcctcccaccccagcctcccaagtagctgggaccacaggcatgtgccaccattcctgattttttttattttttgcagtgagccaatattgtgccattgcactccagcttgggcaacaagagcgaaactccatctcaaaaataaataaataaataagaaacatttgtttatatgtacacacataatctctgaaagggtaaaagtggcatactggttggccagaagaattgggaggacagtgatgaggaataattttcactctttatcattttatatttttggaattttgaaacatgtaaaattattaccagttcaaaaaataaatttaaacaaaaatcttaactgttcaaattaaagtaagtttgataatttctt

SEQ ID NO: 347804 - DNA, 3442 bp, Homo sapiens
gtggagttagaatttgatgtcagcacccagctgaccatggcttaaacagatgaggctttgttcaaaggctgtcttttcagtggctcagctgtgtcacagtcgatgttttctgcaatctctcaacctttccattgtggtcatgaggagactcctatggctccagccattgcatccacagtgaagactgaaagaagggggaatgggcaggccaacacttaccgctgatggtgtttaaaggaaaaacattcccagaagcctgcagcacatgccccccttagtctcactggccacagatgggtcagggggccacccctaataacaacggggcttagaaacctcgtatttacctttctaacctctgtggtggagacaggtgggagagaaaagtcctgggaagtggatgatggaggcagctagccgtagctgctgcttttctcttcaagctcttgggagaattgcttgtgctccctattcccttggtggatgatggaggcagctagccgtatctgctgcttttctccttcaagctcttgggagaatcgcttgtgctccctattcccttggtggcagctcacacctcagacctgctgtccgcccccactgcttcacagaacccactgcaaccactgtccaaggtactacctctggtgtcgtctctcttcatccccaggactgtgaagcctgctaacctctttgcagagctccatctccttgcattgtggggttccttctaactcttcagggacttctcaacctcccgtcacccttcctaaatgctggggtcctagagtccaccttgtgctccacgccctccccaggtgtcatctacatccctagctttgtgctgctcaccaccaaatcagtctggtgcttctgagatttgggcttcagacccaaacaactgctgtgtgctactgggcaactccccgaggtgtgccgaaagctccccaaacccagcctaccccaaacaaaactcattttccacccagactagtctctgcttccctgatccctttcctggaggctgtttccacttgccatcccatcatggaagccagaaaaccagtcttcttgacctctccccttcctcactccatggagttagaggtcctgttgattttgccatgtaaacatttcggatttgcttacttcatccccactgccaccaacagtgcaggatggccctaagaggagaagtaatgtgctaccaagtggcccagccagagtgtgaaccaaacagtctggtaccaaaaccctattctggatcattcctcctttctgctccaccagcagtttggggcacaggcttgggaatccagacaggaaagctcctcccctctgaagcagtgggaccaaaaatgacagcatggttctagacagctctggaagtcaggcctgtgattgcctcattccctccaccttggcccccaaaatggccagtcctgaaggggtcacagttgatacttctctgagggggcatggggttggctgaggttatagcagccccacagggtggtaagctgggatgaagcaatcaactggaactcaacaagccttgagttctcaaagggggtgtgggaaggttcttatacatcttctatgaagggcagtttatcagtcactaaattacaaatacataaaccctttgtctcaccaaacctgctgggaatgaatcctacatatatatttatatgtgtgcaggctacatggttttcattatgctattgattttaaaagtaaaaatttggaaagaacctccatgtccaccatggggaactggctaagtcatttatggtggaatggtgatcataaaaattcattaaaaatgaagactctatatacagcttgaatattccttatcgaaatgcttgggaccagaagtgtttcagatctttgcatattttctgtttctcatttcagttcacattttctaagcatgatattcctactgatttccttgtagatattttgaaacagataagaaactcctccgtggaaattactgttaactagggaaaagacatgtttttttctgttcataaaagtaatgcgagttctttgtagcaaaacttggaaaatgcataaaagtaaaaaaaaaatgaaaacttgtgtaaaattcctcatactttagccatccatagatggtccttaccattaggattttactaattttccttgcagctttttcttaaaatatacacgtgtgtctacacatacatagtgtacactaaattttacatacacacagaggaatatatatgtgtatagttatcttgtgtttagaaatttggaatcccttctagttgtcttgtaacatgtgcttactctattttgaggattttctctatgaatttcatgtagctctttaaattaactttcaggaggattgtaacaatgtgctctccacccagtattttaccagccttgagttttctcaaagggggcattggaggggttcttatacatttacagtgggaatgtgaattgatacaacttctgtggagggcagtttatcagccactatctaaattacacatacataaaccctttgtctaagcaaacttgctgggaataaatcctacacatatatttgtatgtgtgcagactgtttgtacatggttttcattatgctattgattttaaaagtcagaatttggaaacaaccctccatgtccaccatggggaactggctaagtcatttatggtggaatggagatcatagccttaaaaatgaagactctttatatacaggttgagtatcccttatccaaaatgctcaggaccagaagtgtttcagatttcagatttttgaattagggatcctcaaactatactaatgtgagaaagagctctaagatagttaagtagataaaagcaaggtgtcaaactgtagagtatgtttccatttatgtaaagaagaaacaggctaggcaaggtgactcacgcctgtaatcccagcactttgggaggccgaggcgggtggatcacctgaggtccggagttcaagaccagcctgaccaacacggtgaaaccccatctctactaaaaatacaaaagctgggtgtggtggtgcacacttctaatcccagctactccgtaggctaaggcaggagaatcgcttgaacccaggaagtggaggttgcagtgagccaatattgtgccattgcactccagcttgggcaacaagagcgaaactccatctcaaaaataaataaataaataagaaacatttgtttatatgtacacacataatctctgaaagggtaaaagtggcatactggttggccagaagaattgggaggacagtgatgaggaataattttcactctttatcattttatatttttggaattttgaaacatgtaaaattattaccagttcaaaaaataaatttaaacaaaaatcttaactgttcaaattaaagtaagtttgataatttctt

SEQ ID NO: 347805 - DNA, 3388 bp, Homo sapiens
gtggagttagaatttgatgtcagcacccagctgaccatggcttaaacagatgaggctttgttcaaaggctgtcttttcagtggctcagctgtgtcacagtcgatgttttctgcaatctctcaacctttccattgtggtcatgaggagactcctatggctccagccattgcatccacagtgaagactgaaagaagggggaatgggcaggccaacacttaccgctgatggtgtttaaaggaaaaacattcccagaagcctgcagcacatgccccccttagtctcactggccacagatgggtcagggggccacccctaataacaacggggcttagaaacctcgtatttacctttctaacctctgtggtggagacaggtgggagagcttcaagctcttgggagaattgcttgtgctccctattcccttggtggatgatggaggcagctagccgtatctgctgcttttctccttcaagctcttgggagaatcgcttgtgctccctattcccttggtggcagctcacacctcagacctgctgtccgcccccactgcttcacagaacccactgcaaccactgtccaaggtactacctctggtgtcgtctctcttcatccccaggactgtgaagcctgctaacctctttgcagagctccatctccttgcattgtggggttccttctaactcttcagggacttctcaacctcccgtcacccttcctaaatgctggggtcctagagtccaccttgtgctccacgccctccccaggtgtcatctacatccctagctttgtgctgctcaccaccaaatcagtctggtgcttctgagatttgggcttcagacccaaacaactgctgtgtgctactgggcaactccccgaggtgtgccgaaagctccccaaacccagcctaccccaaacaaaactcattttccacccagactagtctctgcttccctgatccctttcctggaggctgtttccacttgccatcccatcatggaagccagaaaaccagtcttcttgacctctccccttcctcactccatggagttagaggtcctgttgattttgccatgtaaacatttcggatttgcttacttcatccccactgccaccaacagtgcaggatggccctaagaggagaagtaatgtgctaccaagtggcccagccagagtgtgaaccaaacagtctggtaccaaaaccctattctggatcattcctcctttctgctccaccagcagtttggggcacaggcttgggaatccagacaggaaagctcctcccctctgaagcagtgggaccaaaaatgacagcatggttctagacagctctggaagtcaggcctgtgattgcctcattccctccaccttggcccccaaaatggccagtcctgaaggggtcacagttgatacttctctgagggggcatggggttggctgaggttatagcagccccacagggtggtaagctgggatgaagcaatcaactggaactcaacaagccttgagttctcaaagggggtgtgggaaggttcttatacatcttctatgaagggcagtttatcagtcactaaattacaaatacataaaccctttgtctcaccaaacctgctgggaatgaatcctacatatatatttatatgtgtgcaggctacatggttttcattatgctattgattttaaaagtaaaaatttggaaagaacctccatgtccaccatggggaactggctaagtcatttatggtggaatggtgatcataaaaattcattaaaaatgaagactctatatacagcttgaatattccttatcgaaatgcttgggaccagaagtgtttcagatctttgcatattttctgtttctcatttcagttcacattttctaagcatgatattcctactgatttccttgtagatattttgaaacagataagaaactcctccgtggaaattactgttaactagggaaaagacatgtttttttctgttcataaaagtaatgcgagttctttgtagcaaaacttggaaaatgcataaaagtaaaaaaaaaatgaaaacttgtgtaaaattcctcatactttagccatccatagatggtccttaccattaggattttactaattttccttgcagctttttcttaaaatatacacgtgtgtctacacatacatagtgtacactaaattttacatacacacagaggaatatatatgtgtatagttatcttgtgtttagaaatttggaatcccttctagttgtcttgtaacatgtgcttactctattttgaggattttctctatgaatttcatgtagctctttaaattaactttcaggaggattgtaacaatgtgctctccacccagtattttaccagccttgagttttctcaaagggggcattggaggggttcttatacatttacagtgggaatgtgaattgatacaacttctgtggagggcagtttatcagccactatctaaattacacatacataaaccctttgtctaagcaaacttgctgggaataaatcctacacatatatttgtatgtgtgcagactgtttgtacatggttttcattatgctattgattttaaaagtcagaatttggaaacaaccctccatgtccaccatggggaactggctaagtcatttatggtggaatggagatcatagccttaaaaatgaagactctttatatacaggttgagtatcccttatccaaaatgctcaggaccagaagtgtttcagatttcagatttttgaattagggatcctcaaactatactaatgtgagaaagagctctaagatagttaagtagataaaagcaaggtgtcaaactgtagagtatgtttccatttatgtaaagaagaaacaggctaggcaaggtgactcacgcctgtaatcccagcactttgggaggccgaggcgggtggatcacctgaggtccggagttcaagaccagcctgaccaacacggtgaaaccccatctctactaaaaatacaaaagctgggtgtggtggtgcacacttctaatcccagctactccgtaggctaaggcaggagaatcgcttgaacccaggaagtggaggttgcagtgagccaatattgtgccattgcactccagcttgggcaacaagagcgaaactccatctcaaaaataaataaataaataagaaacatttgtttatatgtacacacataatctctgaaagggtaaaagtggcatactggttggccagaagaattgggaggacagtgatgaggaataattttcactctttatcattttatatttttggaattttgaaacatgtaaaattattaccagttcaaaaaataaatttaaacaaaaatcttaactgttcaaattaaagtaagtttgataatttctt

SEQ ID NO: 347806 - DNA, 3680 bp, Homo sapiens
  misc_feature (3680)..(3680): n is a, c, g, or t
gtggagttagaatttgatgtcagcacccagctgaccatggcttaaacagatgaggctttgttcaaaggctgtcttttcagtggctcagctgtgtcacagtcgatgttttctgcaatctctcaacctttccattgtggtcatgaggagactcctatggctccagccattgcatccacagtgaagactgaaagaagggggaatgggcaggccaacacttaccgctgatggtgtttaaaggaaaaacattcccagaagcctgcagcacatgccccccttagtctcactggccacagatgggtcagggggccacccctaataacaacggggcttagaaacctcgtatttacctttctaacctctgtggtggagacaggtgggagagaaaagtcctgggaagtggatgatggaggcagctagccgtagctgctgcttttctcttcaagctcttgggagaattgcttgtgctccctattcccttggtggatgatggaggcagctagccgtatctgctgcttttctccttcaagctcttgggagaatcgcttgtgctccctattcccttggtggcagctcacacctcagacctgctgtccgcccccactgcttcacagaacccactgcaaccactgtccaaggtactacctctggtgtcgtctctcttcatccccaggactgtgaagcctgctaacctctttgcagagctccatctccttgcattgtggggttccttctaactcttcagggacttctcaacctcccgtcacccttcctaaatgctggggtcctagagtccaccttgtgctccacgccctccccaggtgtcatctacatccctagctttgtgctgctcaccaccaaatcagtctggtgcttctgagatttgggcttcagacccaaacaactgctgtgtgctactgggcaactccccgaggtgtgccgaaagctccccaaacccagcctaccccaaacaaaactcattttccacccagactagtctctgcttccctgatccctttcctggaggctgtttccacttgccatcccatcatggaagccagaaaaccagtcttcttgacctctccccttcctcactccatggagttagaggtcctgttgattttgccatgtaaacatttcggatttgcttacttcatccccactgccaccaacagtgcaggatggccctaagaggagaagtaatgtgctaccaagtggcccagccagagtgtgaaccaaacagtctggtaccaaaaccctattctggatcattcctcctttctgctccaccagcagtttggggcacaggcttgggaatccagacaggaaagctcctcccctctgaagcagtgggaccaaaaatgacagcatggttctagacagctctggaagtcaggcctgtgattgcctcattccctccaccttggcccccaaaatggccagtcctgaaggggtcacagttgatacttctctgagggggcatggggttggctgaggttatagcagccccacagggtggtaagctgggatgaagcaatcaactggaactcaacaagccttgagttctcaaagggggtgtgggaaggttcttatacatcttctatgaagggcagtttatcagtcactaaattacaaatacataaaccctttgtctcaccaaacctgctgggaatgaatcctacatatatatttatatgtgtgcaggctacatggttttcattatgctattgattttaaaagtaaaaatttggaaagaacctccatgtccaccatggggaactggctaagtcatttatggtggaatggtgatcataaaaattcattaaaaatgaagactctatatacagcttgaatattccttatcgaaatgcttgggaccagaagtgtttcagatctttgcatattttctgtttctcatttcagttcacattttctaagcatgatattcctactgatttccttgtagatattttgaaacagataagaaactcctccgtggaaattactgttaactagggaaaagacatgtttttttctgttcataaaagtaatgcgagttctttgtagcaaaacttggaaaatgcataaaagtaaaaaaaaaatgaaaacttgtgtaaaattcctcatactttagccatccatagatggtccttaccattaggattttactaattttccttgcagctttttcttaaaatatacacgtgtgtctacacatacatagtgtacactaaattttacatacacacagaggaatatatatgtgtatagttatcttgtgtttagaaatttggaatcccttctagttgtcttgtaacatgtgcttactctattttgaggattttctctatgaatttcatgtagctctttaaattaactttcaggaggattgtaacaatgtgctctccacccagtattttaccagccttgagttttctcaaagggggcattggaggggttcttatacatttacagtgggaatgtgaattgatacaacttctgtggagggcagtttatcagccactatctaaattacacatacataaaccctttgtctaagcaaacttgctgggaataaatcctacacatatatttgtatgtgtgcagactgtttgtacatggttttcattatgctattgattttaaaagtcagaatttggaaacaaccctccatgtccaccatggggaactggctaagtcatttatggtggaatggagatcatagccttaaaaatgaagactctttatatacaggttgagtatcccttatccaaaatgctcaggaccagaagtgtttcagatttcagatttttgaattagggatcctcaaactatactaatgtgagaaagagctctaagatagttaagtagataaaagcaaggtgtcaaactgtagagtatgtttccatttatgtaaagaagaaacaggctaggcaaggtgactcacgcctgtaatcccagcactttgggaggccgaggcgggtggatcacctgaggtccggagttcaagaccagcctgaccaacacggtgaaaccccatctctactaaaaatacaaaagctgggtgtggtggtgcacacttctaatcccagctactccgtaggctaaggcaggagaatcgcttgaacccaggaagtggaggttgcagtgagccaatattgtgccattgcactccagcttgggcaacaagagcgaaactccatctcaaaaataaataaataaataagaaacatttgtttatatgtacacacataatctctgaaagggtaaaagtggcatactggttggccagaagaattgggaggacagtgatgaggaataattttcactctttatcattttatatttttggaattttgaaacatgtaaaattattaccagttcaaaaaataaatttaaacaaaaaaaaaaaaaaaaaaaaaaaaaaactgtggtggggccggccgcggacccgagaaagaaggtttctgaacccttccgtgggcgccgcgggcgccgcagtaggtcattgaccattggccaacacgcggtggccaaggaaacccgggcctggatctaggggttggttcttccaccataaaaaaaccccgcgcggccccggcgttcggaccaatcccagagcggtcggagctaccggtctcacacgggtccacgcccgtagccccccccccgcggtgcggggn

SEQ ID NO: 347807 - DNA, 1986 bp, Homo sapiens
  misc_feature (1937)..(1937): n is a, c, g, or t
gtggagttagaatttgatgtcagcacccagctgaccatggcttaaacagatgaggctttgttcaaaggctgtcttttcagtggctcagctgtgtcacagtcgatgttttctgcaatctctcaacctttccattgtggtcatgaggagactcctatggctccagccattgcatccacagtgaagactgaaagaagggggaatgggcaggccaacacttaccgctgatggtgtttaaaggaaaaacattcccagaagcctgcagcacatgccccccttagtctcactggccacagatgggtcagggggccacccctaataacaacggggcttagaaacctcgtatttacctttctaacctctgtggtggagacaggtgggagagaaaagtcctgggaagtggatgatggaggcagctagccgtagctgctgcttttctcttcaagctcttgggagaattgcttgtgctccctattcccttggtggatgatggaggcagctagccgtatctgctgcttttctccttcaagctcttgggagaatcgcttgtgctccctattcccttggtggcagctcacacctcagacctgctgtccgcccccactgcttcacagaacccactgcaaccactgtccaaggtactacctctggtgtcgtctctcttcatccccaggactgtgaagcctgctaacctctttgcagagctccatctccttgcattgtggggttccttctaactcttcagggacttctcaacctcccgtcacccttcctaaatgctggggtcctagagtccaccttgtgctccacgccctccccaggtgtcatctacatccctagctttgtgctgctcaccaccaaatcagtctggtgcttctgagatttgggcttcagacccaaacaactgctgtgtgctactgggcaactccccgaggtgtgccgaaagctccccaaacccagcctaccccaaacaaaactcattttccacccagactagtctctgcttccctgatccctttcctggaggctgtttccacttgccatcccatcatggaagccagaaaaccagtcttcttgacctctccccttcctcactccatggagttagaggtcctgttgattttgccatgtaaacatttcggatttgcttacttcatccccactgccaccaacagtgcaggatggccctaagaggagaagtaatgtgctaccaagtggcccagccagagtgtgaaccaaacagtctggtaccaaaaccctattctggatcattcctcctttctgctccaccagcagtttggggcacaggcttgggaatccagacaggaaagctcctcccctctgaagcagtgggaccaaaaatgacagcatggttctagacagctctggaagtcaggcctgtgattgcctcattccctccaccttggcccccaaaatggccagtcctgaaggggtcacagttgatacttctctgagggggcatggggttggctgaggttatagcagccccacagggtggtaagctgggatgaagcaatcaactggaactcaacaagccttgagttctcaaagggggtgtgggaaggttcttatacatcttctatgaagggcagtttatcagtcactaaattacaaatacataaaccctttgtctcaccaaacctgctgggaatgaatcctacatatatatttatatgtgtgcaggctacatggttttcattatgctattgattttaaaagtaaaaatttggaaagaacctccatgtccaccatggggaactggctaagtcatttatggtggaatggtgatcataaaaattcattaaaaatgaagactctatatacagcttgaatattccttatcgaaatgcttgggaccagaagtgtttcagatctttgcatattttctgtttcttcatccttgggacgcagtttctcantccttgggaagctcccaaggaatgaggaatgtggggtaccggagctcga

SEQ ID NO: 347808 - DNA, 325 bp, Homo sapiens
tttattggaatacagcctcattcattcatttacatattatctatgactgttttctctataatggcagagtggagcaggaaggacagtggctcagtatccagtaaagatgaaaatatttactatttctgtctttatcaaaaaagaaggaaagaaagaatgaaagaaaggaaggaaggaaagggaagggaaggaaggaaggaaggaaggggaagaaagaaagaaaggaaggaaagaaagaaagaaagaaagaaagaaagaaagaaagaaagaaagaaagaaagaaagaaagaaagaagaaagaaagagagagagaaagaaaaaaaga

SEQ ID NO: 347809 - DNA, 271 bp, Homo sapiens
agtttgaatggtaacgtttaaatgtctgctgctacggaagcaagaaaattcactccctgtgtggctgctgattctgagaagtgttctgtttaagtccagcccatcttctctccaccattccacacacacacagccacatcatccctgcttcacccggcataccaggaggaggcaggaaggactttggaaaacttttatactgaatgcagaacttggtactccagatcaaactgcagaagtaaatgataatccttccccttcaaggccctca

SEQ ID NO: 347810 - DNA, 1519 bp, Homo sapiens
tgaaagaactgtcttgggccacacataaaatacactaacgatatttgatgagcttaaaaaaaaacgcaaaaaaaaaaactcacagtgttttaagaaagtttacaaatttgtgttgggcagtattcaaagccaccacaagctgcaggttggacaagcgtgtgctacacatttaactcacctgagtttcacaaacactcagcagagggcgtggtgagggaagtttcaacaatgttcctccacttactggaatcaaaaaaagtgttttgagaaaagaattatttcctcctgccagtcctgccctagacatccatttgtaaagaaactttcaacatttctcaagtccaagaagtggacggtcagtgtttgttttgcatggaacaaagaaagcttccctaacatcctaagatgtacaattctgattatacatacagagtttctgggtgtgaaaacagtattttttcattcccggttttttggctgtgctccaagatttctttttttaccaaataatctttagtgagatcctttcttgggaagaagtagagggtttttcaaagacttttatgaaaatatttgcacatacacatagatatacattttagcatttcatgtaatgataccaagtgttctttgaggttctaaaaagaaaaataatctaaaattacctaatcctatcaaaatttccaatagaggctatcactaccatatctaaatcacataatcgtttttgctggcaaagagaaaggaaaattaacatgctctgtgcacttactatatgctaggcatttaacatgtattttaaactaaatcttcctaacaaccctaataagtgggtaatattattgtctaaatattacagatgagaaaaatggggcactgagaggctagtaaggtgttaacttagggcaccaaatagtaaatggcaaaaccaggatgtgaaccctagcaatctgactgcaacatttgaactactctgtgttaatactgacataggagttaaaaagaaattacttgggtagatagggtacgggagtcctcagtaaggtttcccttttaatgaaaagcagccccaaatcactttcctaacaaagagcagcctataaaatagagctgcagacatatatgccggcagttgtgccaatcaggttcaaaatggcggctccatcttcccttctctgccagccacgtgtactgtaaagggcagccaaaatgacgccggtcaaggggaaagtacatttgcatcctaagattagggtgggtcttcctacaattgtagattctaatttactcccctaaactactgttttaaaacaaattaaaactgatttatatactggagataaccaggtacagtctgaagctccttagaacagaacaaatatttgcatgttgggaaataaaatatatttttttagaagacaaatggctaattaaggttcaaaactaattcacattaaagaatcagaatattctagtcaaaattttaaattaaaaattgctttctatagtaggtagggga

SEQ ID NO: 347811 - DNA, 617 bp, Homo sapiens
ggaaaacgccttacttgtctgtctgccgccaaagaaaaaatatagctttgtgataagagcatggggcctggaatcagaccacctagcatttaatcctggctttataattttctatgtaatatgttttccagtgaattacttagattgtatgtccttatgtcaattacttttctatctgtaaaactgaggtactgtacatcgtatagattgtgagagttaaatgagctataacaggtgaagtgcttagaactgtatctagcatataagtactcaatacatgttagttgtcattcatattgatattactgcctggtgcttaaataagtttttttgaattaaacttaagctaaaatttagtgtaggataactaaggtacttatttggaatggggggaagttattatgcttggaacttggtttgatggcttgtactatgtgtcagtcatttaacttaccatacttaatgtacacaacacttcttgaagtaagaattatcattccttattttctggataagaaaacagactctcagactcttcagggttcttccttcctgttaaatagtaaagttgcagtgtaactctagatttgtttaactctaaagcctgtttcttcaca

SEQ ID NO: 347812 - DNA, 251 bp, Homo sapiens
tcgacagcgtctatgtggggccaggcacatggcaggcctcagcatgtatctgttgaatgagagagcttgggaaagaagggtcagaccagatcataaagggccctaaaggactccctacagttaaattttatattgcagggaatagggaaccattgagagttataatgaaatttgagcttttttaaaaaaaaatcacgcagcctgcagtatgctgaaaggctcagagggaggcaggctgcaggcaggagacc

SEQ ID NO: 347813 - DNA, 473 bp, Homo sapiens
ccgggtgatctgagatcccgataactggtaggagactattcataacaattaataaagaagtttgtgatggttaataatgagtgtcagcctgattggattgaaggatacaaagtattgatcctgggtgtgtctgtgagggtgttgagtcagtgggctgctattccttgaaaatggcaagtgagtcatggcagtactcgggaaaagtacatactacatggaaatgactgcactccagcctgggtgacagagcaagaccctccctgtctctaacaataaaaatagtgctcgcttcagcagcacataaactaaaattggcatgatacagagattagcacaggccctgcgcaaggatgacatgcaaattcgtgaagcagttgcatatttttaataaatggcgttgggaaaactggatattcatatgcacattgagaacctcaaggaggagctggcctacctgaagaagaaccacgagg

SEQ ID NO: 347814 - DNA, 2432 bp, Homo sapiens
tgagtgactcagccgctgagcaagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcttcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccag

SEQ ID NO: 347815 - DNA, 514 bp, Homo sapiens
tagagcccacgaggcccacaaaatatacgtgttccttgattcgatatatatgtcttttattttactctatgattttttttttttcatggagaatgtttattgcatttgacctttcaagataccacacaatttcatttcagtatgcagccttttatgtgaatttctttgtgttttcagagccaaaagccttgaaagtctcatctatatgagtacccggacagataaagatggcaaagggtaagattttattaagacagaccattttgattgagtcccagatggtgtactattttctggaggagacctcctgcttagtacaagggtcaggcaggctggtggaataagccttagactggggtccagggatagtgtgtatcttggtgctggttttgccaccaacatcaatctgggtgaccctgggcaagttgtgtaatttctggagagctctgtttcctcattccataaaatgaaggatatgacctagatgatctcccagttccccttcatatctaaa

SEQ ID NO: 347816 - DNA, 632 bp, Homo sapiens
  misc_feature (554)..(554): n is a, c, g, or t
  misc_feature (561)..(561): n is a, c, g, or t
gaacaaatgttttctagaagctacgtgtgcaagtacattgcacaatgctgtaattaatcagtgtacctatgtgtggactcaattaaaatgaagaattggataatctcatcaaaatgaacaaaagcttgaatagagccaaaagccttgaaagtctcatctatatgagtacccggacagataaagatggcaaaggaatccaaagccttggaagtccgattaaagttaatcaaaggactgacaaaaatgagaaagggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacangatcttngataactcattaagggtgaatccttgaattctgcagtaatcagaaacaatcagagccaagacttggacatt

SEQ ID NO: 347817 - DNA, 3582 bp, Homo sapiens
acctttccctccacacctcccggcaagctgagggagccgcctccggccttggccagcccagaaagtggctcccacagtgcagcagcgggttgaagggctcctcaagcgcggccagagtgggcgccaaggctgaggaggcgccaagagcgagcaagggctgtgagggctgccagcatgctgttacctctcactgggattacaggcatgagccaccgcgcccggcctgaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcttcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagtgaagaccttgataatgctactgaagtaaatcccaaaggacatgaaaataccactgggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacatagaatctttatgtgaagtgtttgtaaatataattcactaacatcaattttgtcaattatagtgatcacaatctattatattctctgcagcactaatttatttttaactgctcaagctatagattttatttttaagaaacttttctgaagaaattgaacatgtaataatcatgtgaggaactagtataattaacattgggaaattgaacttctaaaccatttaattgcatatagcaactgtttctagaaaaaagatgtatggaacatggaagtgggggcagaattctagagaagttttaaggcagttgtggaaaactgctataaactagggagattaaaagattatcatgtattttccaaatgttaatacattcaaagaattattcttctgtgtaataatttcatgcctctgttcctcttaaagcctggttcacaaagtgttaaacataaaatgcttatcaaaa

SEQ ID NO: 347818 - DNA, 3321 bp, Homo sapiens
tgagtgactcagccgctgagcaagaaacctctgaactgttcactaatacagtcaggtagaggttgagactccactgaataaactctaggttcccatttctttcagccagatcctcccagggaatcactacaggctggttagccaaaaagtcctgattttctgctcaatagagctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcttcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagtgaagaccttgataatgctactgaagtaaatcccaaaggacatgaaaataccactgggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacatagaatctttatgtgaagtgtttgtaaatataattcactaacatcaattttgtcaattatagtgatcacaatctattatattctctgcagcactaatttatttttaactgctcaagctatagattttatttttaagaaacttttctgaagaaattgaacatgtaataatcatgtgaggaactagtataattaacattgggaaattgaacttctaaaccatttaattgcatatagcaactgtttctagaaaaaagatgtatggaacatggaagtgggggcagaattctagagaagttttaaggcagttgtggaaaactgctataaactagggagattaaaagattatcatgtattttccaaatgttaatacattcaaagaattattcttctgtgtaataatttcatgcctctgttcctcttaaagcctggttcacaaagtgttaaacataaaatgcttatcaaaa

SEQ ID NO: 347819 - DNA, 1463 bp, Homo sapiens
  misc_feature (1400)..(1400): n is a, c, g, or t
  misc_feature (1404)..(1404): n is a, c, g, or t
tgagtgactcagccgctgagcaagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcttcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactgggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaaaangtcntgatgaactattagtgacagccccaacctgtcaaaacattatagaaccaaacctgataa

SEQ ID NO: 347820 - DNA, 435 bp, Homo sapiens
cagatttataaccttaatgatattaccaaaagaacttcaaaattaacctgctctcattttattttttgatttaaagaaaccaagatcttgctaacctcatcaaagtaaatcctgcagtaatcagaaacaatcagaggtatatatagaagcagtcaattcatgtttttatttgtctgttgccctggatgaagtggatttataatgttgctttattgacctagcacaaccccaaaatctattaccaatctgaacttttttctctctctcttttaaacagccaagacttggacaatcttattaaagtgaaaccttcagctcttagaaacactaatcggtaaatgaccttgactatcttgacatgtttacaagtttctagggtaggaacttctccctccctccttgcctccctgcctccctcccttcctcccttactcc

SEQ ID NO: 347821 - DNA, 2492 bp, Homo sapiens
tgagtgactcagccgctgagcaagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggatctcagacagaaatgatgctgctaaaacatataaggccaataccttggataaccaactaaccaataggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcttcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataaggagtcaggatcttgataacatcgtcaaagtggccacttcacttcagagaagtgacaaaggtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagacaaaatctcgaatctgttgctaaagtgaatgccaggatgaataaaacgagcagaagaagtgaagaccttgataatgctactgaagtaaatcccaaaggacatgaaaataccactggaaaaaaagaccttgatgggcttattaaagtggatcctgaaacaaataaaaatattacgaggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccag

SEQ ID NO: 347822 - DNA, 3457 bp, Homo sapiens
tgagtgactcagccgctgagcaagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcttcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagtgaagaccttgataatgctactgaagtaaatcccaaaggacatgaaaataccactgggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagacttagtgtttgaaaactgtgttttaaaaacagaaacagattgatgggtaacaggtaaaatatgacatgtatagcttacatgttattatttgttaaattttctttgtatacatttcaaaatctgggtatacttataatccattagaagtaatggttatggactaaaaagatatgttctttagtatgttatatatactcatattacatagcagtatgtttacaaaaggcttataaaaataaaatgaactatcagttacatagaatctttatgtgaagtgtttgtaaatataattcactaacatcaattttgtcaattatagtgatcacaatctattatattctctgcagcactaatttatttttaactgctcaagctatagattttatttttaagaaacttttctgaagaaattgaacatgtaataatcatgtgaggaactagtataattaacattgggaaattgaacttctaaaccatttaattgcatatagcaactgtttctagaaaaaagatgtatggaacatggaagtgggggcagaattctagagaagttttaaggcagttgtggaaaactgctataaactagggagattaaaagattatcatgtattttccaaatgttaatacattcaaagaattattcttctgtgtaataatttcatgcctctgttcctcttaaagcctggttcacaaagtgttaaacataaaatgcttatcaaaa

SEQ ID NO: 347823 - DNA, 2768 bp, Homo sapiens
tgagtgactcagccgctgagcaagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcttcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaaggaatccaaagccttggaagtccgattaaagttaatcaaaggactgacaaaaatgagaaaggaagtgaagaccttgataatgctactgaagtaaatcccaaaggacatgaaaataccactgggggccagagccttgataatctcatcaaagtgacccctgaagtaaagagaagtaaccaaggttccaaagaccttaataacttcatcaaagtgtatccaggaacagaaaaaagtactgaagggggccaaagtctcgacagcctcattaaagtgactcctgaaagaaacagaactaaccaagggaaccaagacttggaaaatcttatcaaagtgatcccttcagcaaacaaaagcagtgaacaaggtcttgatgaacatattaatgtcagccccaaagctgtcaaaaacactgatggaaaacaagatcttgataaactcatcaaggtgaatcctgaaattttcacaaacaaccaaagaaaccaagatcttgctaacctcatcaaagtaaatcctgcagtaatcagaaacaatcagagccaagacttggacaatcttattaaagtgaaaccttcagctcttagaaacactaatcgagaccagaacctggaaaatttaattgaagtaaattctcatgtgtctgaaaacaagaatggaagctctaacactggagccaagcaggcaggaccacaggatactgttgtgtacacaaggacatatgtggagaatagtaaatcacccaaggatggatatcaggagaatatctctggaaaatacatacaaactgtttattcaacttctgataggtctgtcattgaaagagatatgtgcacttactgccgaaaacccttgggtgtagaaactaaaatgattttagatgaattacaaatttgctgccattctacttgctttaagtgtgaaatatgcaagcagcctttggaaaatctacaagcgggtgatagtatttggatttatagacagacaatacactgtgaaccttgctactctaaaattatggcaaagtggattccataactctggcacaaggaaatcaagatgaaaagcactcattaaggaattaaagttacaagttttatcttaataatatgtaatctagaaaagctttcacattgaagatcaactcttgtacaaaattaacaattctgttattgcataagtaatctaattgtcttcaataaggtcacacacataaaaagagccatctggtctctggctagagttagcaataaaaagttcaaatggttccagattccagtgtcaaaggagtgatgcattacactccagccaggtccatccctgctccgtatgttggctgtgagtggtggtttccatttaaaccaagtttctcatttcttcacctttttttctctaagaatttggattcgtagacattgacatcccgaagaactgtcaaggaagcaagatatgctttcttcatctgcaaaagaaatactaacaacaattttcttatacagtttggcagaaagatgttaacataaaaagtttatatacctcaaaaatcactaaactttccagatctctgtcctattatttgtaacacaaggggcattggataaaatgatttctagggttccttttgcttcccaaattctctgattctaaagcagtttttagaatcattagctctttggaaacatatatgcatacatgtttgttaagcctattgaactaggtaggacatataaacaatttaattttagtgtcattgtttaatcacagccattaggtaacagccatttagggagatcctgt

SEQ ID NO: 347824 - DNA, 1256 bp, Homo sapiens
tgagtgactcagccgctgagcaagaaacctctgaactgttcactaatacagtcaggtagaggttgagactccactgaataaactctaggttcccatttctttcagccagatcctcccagggaatcactacaggctggttagccaaaaagtcctgattttctgctcaatagaggtccttactggaaggcagcatgtccaatgttaccttgagaaaaatgtctcccacaggaaatgagatgaagagcaccactcagggaaccacacggaagcagcaggattttcacgaggtgaacaaaagaagaactttcttacaggataacagttggataaagaaacgccctgaagaagaaaaagatgaaaattacggtagggtggtgctcaaccgacataattcccatgatgcattggacaggaaagtaaatgagagagatgtgccaaaagctacaattagtcggtacagttctgatgacactttggacaggagcatgtccatgtttagatcactggaagtaacaaagttgcaacctggcggttcattgaatgccaacacctccaacaccatagcatccacttctgctactactcctgtaaagaagaagaggcagtcctggtttccaccgccccctccaggttacaatgcctcttcgagcacaggaaccaggagacgggaaccaggtgttcaccctccaatacctccaaagcccagttctcctgtttcttctcctaaccagctgagacaggataataggcagatacatccacctaaaccaggtgtatatacagaaaccaacagatctgctgaaagaaatataagtgaagaattggataatctcatcaaaatgaacaaaagcttgaataggaatcaaggtcttgatagtctcttcagagcaaatccaaaggtagaagaaagagagaaaagagccaaaagccttgaaagtctcatctatatgagtacccggacagataaagatggcaaagggtaagattttattaagacagaccattttgattgagtcccagatggtgtactattttctggaggagacctcctgcttagtacaagggtcaggcaggctggtggaataagccttagactggggtccagggatagtgtgtatcttggtgctggttttgccaccaacatcaatctgggtgaccctgggcaagttgtgtaatttctggagagctctgtttcctcattccataaaatgaaggatatgacctagatgatctcccagttccccttcatatctaaa

SEQ ID NO: 347825 - DNA, 222 bp, Homo sapiens
catttcacatttatagatttattctgagataactggataagtaggtaaagatgcttaaataaggtgattacagtgaaaatttttccttttttttctctaaacaaatctcatcacagtgttcacaggaaaaattcaaatgcataggcagatacatgctttattctttttctgaaaggttaaccataaatgagactttaataaatgtcccatacaattctgtac

SEQ ID NO: 347826 - DNA, 305 bp, Homo sapiens
attgaagaaataattttttataggactctggagtgaagggattaatattgaccagagccaatgaggtcatctcatccttgaggggagcaggtgtgagcttcaaatgcttagggcctctggaaggaagcttccctgttggagaaatcaccaaccggctcagcatggtctgaatgaggatgacaaaagagaagcccctatgagaaggatggaaaactctttgaagaaaaaaacaactattatacaatcaagctgtccctcttctcttccagttatatagccaaaggaaataaaatcactatctcaaa

SEQ ID NO: 347827 - DNA, 6330 bp, Homo sapiens
tagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggatgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagcgggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggccaactgctttgatctcaccccagactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgaggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctcagatcctc

SEQ ID NO: 347828 - DNA, 343 bp, Homo sapiens
  misc_feature (23)..(23): n is a, c, g, or t
gcaaaacccagctaatttttgtntttttagtagagatggggtttcaccatgttgtccaggctggtctcaaagtcctgacctcaagcgatccacccacctcagcctgcactacgaggagctcccggcacaggaagagcctccagagccccccttgcagatcggcagctgctcagggtacatggagctgatggtgaagttgaagcaaaatgaggccttccctggccccaaggtgggtccccaggcccctggggagggggtgagtaccccatctcaagactcctcctcctcagcaaggctgattatctacagcccacagtggggatgtcaagtgggggatttactt

SEQ ID NO: 347829 - DNA, 6235 bp, Homo sapiens
tagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggatgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagcgggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgaggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctcagatcctc

SEQ ID NO: 347830 - DNA, 6977 bp, Homo sapiens
tagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggatgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagcgggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgaggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgcaaaaaaaaaaaaaaaaaaaaaaaaaaaaaaaaaaggggggggggtcaaaaattcccgaggggccaaactggcataccgccctgttttcttggtaaacacgttggccccttaatggtgggctccgtataaaaagctatagcatgggcccggtcgttttacaggagggtctgctactttgggtaaaacctgtcgtaaggcgggcgaacttctttggggcagagcgacccttaacttggggcgggggtgcgacataacttgtgcgaacaactctatcctatactacgatctttacacacgcgcctcttacggcgttaacaataatacaccctttcacacacttgtctccagcgggtgttcaacccctacacccggactaatagtgccctgccccgctgatagaaagaagttttggggctcgagggggcatttgccactctctgcgcaccacctctcttactcccccgcggcggagttaacatcgaaaaaaaacctttctccctgcttgatgtcaccgatccatcttgctctcacatcaccaactctcttactctccaactaccacctatactccgactacttgctatactccttagctatctcccttcctgcgccctctactgctgccgtctggactcatatccagcacctctcctcatacccccgttccattcctcaccatactccagctcacc

SEQ ID NO: 347831 - DNA, 5066 bp, Homo sapiens
tagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggatgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagcgggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgaggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgttagtactttaatcaagcagatatgggagatggtgaattaccatctacagtgttgtcatatatgtcacatactgagcattatcagctagtagaatctagttaattgttctatgtgtgatgtatgcagagttcccattttgaatgtgtttttactatgcttaaataaatgactgatgtcagcaaccccaaaatgatacatctgatgtaagagcccctgttccccaataataacatctaaactatagacattggaatgtacaggtgcccctaagtttcctccctcagcctggatgacagagtgagaccctgtttaaaaaaaaatagttagatttttctcttccgagagactgaa

SEQ ID NO: 347832 - DNA, 279 bp, Homo sapiens
gaagcggctggaggctgtgcacggggagctggtgctggacatggagcacggtaccctcttcagcgtctcccagtactgtggccagccaggacttggctacttctgtctggaagctgaaaaggcaacactctaccaccgaggtgtgaggcctgggggcaggtcaccactggggtccagggttgggggtggagggctttcaggacggatgtgggccctgggtggagtgggtagccagttggcttggcagggggctcatgagacccctccccagcggccgtg

SEQ ID NO: 347833 - DNA, 6306 bp, Homo sapiens
tagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggatgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagcgggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgaggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctcagatcctc

SEQ ID NO: 347834 - DNA, 6401 bp, Homo sapiens
tagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggatgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagcgggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgaggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcaggtaggctgctggactgcgggtggggggccctgggccagattgctgggggccaggccagtgagcaaagaaccccctcttcctgctcccctacccagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgccagcccccctctcagatcctc

SEQ ID NO: 347835 - DNA, 5565 bp, Homo sapiens
tagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggatgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagcgggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgaggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggtgagtccccagcaccccagcctctctccagggtccctgatcttccttctgttctggtcctgactggttgtgtggccttggccaagtcatcacccttctcagggcctcaatttctcctctgtaaaaaggacgcagttggctgggcatgatggctcacacattcaggcattcgagaccagcctgaccaacatggtgaaacccccccgtctctactaaaaatacaaaaattagccaggcgtggtggcatacacatgtaatcccagctactcaggaggctgaggcaggagaactgcttgaacctgggaggcggttgcagtgagccaagatcgcaccacttcactccagcctgggcaacggagcaagactccatct

SEQ ID NO: 347836 - DNA, 736 bp, Homo sapiens
atgtcattctactgcttaaactttttcatggctctccaaagtttacaagataaactctcatctttttggtatggcatgttgtgcgactgtcaggatatggccaacacctacctgacgacaatatggatccattttttcctacttaacattagaaaatacccaatttctgggtcattaaaatctcacaaaatatatgtggacagtttcttccctttctcttgaacatttagagtgtttccaatataattgtgacattataaatactactgcaaagaaccacgtagtgaggttttatttttgtttgcttgttttatcaggagtagtcatgttatttcctcagaatatagtcctagctatagacttactgttcaaaggaatgatgttataaatcattcagcttcctcatacgacccttccccttgcttctaataaactccattctttaggactcagctcggatttttttgatggaaaaactttctattccccaactttttagccagcctctctgtagttccacaaacatggtgcaaaactctatcataacacatatcaaaataactgtagttatgacttttcttcttcattaaactataaatcctttctgtaaagactcattcttcttgtatctgtaactttctagtgttacagatgtaaggaaatactaactatatataaactaaatttccagcagtatataaaataagacaaaaatgcctgtcctcccagagctgac

SEQ ID NO: 347837 - DNA, 813 bp, Homo sapiens
tcccgtctggtaaatgagaaatggtatcttgtagttgttttacaatatgtgtttatctaattctgagtaagtctgttcgagggtcattgttctattttattttgtgcattgtctgtccgtgtctttttcttccacctttctgtgagggcttgatcctttgttccttgatatttaaaagcactttatataccataaatatcagcccttcgtctgtggcatatgttaggaatatttctctcagtttgtcaagtactttgtcttctgactttgtttaaggtgttctgtgatttttttttttgtcgaaaatttaaaaatgttcatgtaataaaactgatcagtttttttattttattgcctctagatcttaagtcatagttagaaagcctttcccacccacaagtttaaaaaggaatttacccatgttttcatttagtagttgtatcattgtttacatctagatcccaaatccacttggagttcatctctctgtatggtgtgagacttgaatcaaatttcaccttttcccacatagctacccagtagtccgagcaccatttattaaaaagtctgtcttaaccccagtgacctgtgataccacctttgttatgtactgtatttccgtagacatttgggtctaattctgaacttactattatctttggtctatttgccaattcacacaccagtaagcacactgttttaattacagaggctttccagtatgttttactatctggcaggaatagttttacttcttctttacccctttctaatgcttctaattgacttctctcatttaatcacatttgctaa

SEQ ID NO: 347838 - DNA, 425 bp, Homo sapiens
gctgaagccaggaaatgacccaacattgagggtaatctgggcactgaaggcactacaattcccaggatttttcaagaaaatgtcgaatgtgctgccacatatgtcggatgcacatggatcccctcccacaaggaaaatcacgattgaagatcacctccttgaagatgtcgtattgggagcggtgtttttccctgttgctgacaggttagacttgcacaggcgtcagtactgaggtgtgagacggagcccatgtatggcttctatctctgcactgtggctgctccgttcatgtgtcagtcacatcagctcagagactgcctaatgtcaactggcctagtcattttgtctactctgttgttcagtgcctcttctgtgattgatgctttctagtgttcatgaatacaagagccaaaaatcttcacata

SEQ ID NO: 347839 - DNA, 1638 bp, Homo sapiens
cccacgcccctcagatgagtctcacgccaatggcaggaacagatccgagctattagaagtctcgggaacctccagagatgacagaaggtggcagatttggtccaagccctcaccccactcgagaggagggcgtcggggaaagctgtggctgcctggagagggagcccctgatcccacacttccttggagcctgagtgtgagaggaagctaatgtcagccgggctagacaccgtttaaagtctaatccatgaaaccctaagccgcaaatgacacttggggctttgcagacacccgcagactcagcagatactcctgcggtaacacactgtgctggaaaacgcctggagccatgacacattatgtatttttattattatttatggtaggaagaggagatgagggaaaatcgggctgaatctaagcagcctgacaattcagctagttaatatttagccagttaagaaaggtggttgtaatccctgcaaggcagtgagctctcctttgatttctctaatagcttaaaaaataatttcttacaagacaattagaaattctgcctatggatgcaaatttcatagaaaacaatgttaagccttgaaagtgggtaaaatgtgccttcgattgaagtcatttattctgttgatacacttctacaacatatatattttaaacctgctcagataaagtgaaatttagcaaaaggatatcccctcccacccccaaatctaacatgccattttaaaaacagcacaaaggaacaaggaaactaaatattattttgagccatcattacttagtgaaatacaaacatccaaatagaaacgattgttgttccaccagaagattagaagttaaattatttccacacaataggaatttcacttcgtgtcatcggggatgtagtaggagttgcattatttgtcaaaccaaatagagatgcgtgggctgactttgctgaaatacaaaagaattgaaccttatctgaaggcgttttctaagtggcccctcccatagaagccgggaagttgtccacccctagcagaagccacattaatatttacaaaatggttataaatccttgaagacatttttgcccattttgtataagaaacaggagtaaacaaggtgtttatacttgttatgtttcattaatgaaatattattactttacatcttggggaatgtttgttttctttagaaatgaactaatgatcactacaaaggaagaattcatgacagcatttcctagagaaaaagcttaggtacgcgtctccaaatgatggtttctttttctacaccttagctttttcatagctcaattcttcttacaacttctcttgtgttttttctttgattgtcagttttctttcaaagtttattttttgttacttaatgcagaaaagtgagctctggtctccccagtgtaaaagtcgattgtgtctagaaagaaggcagtaaaaacagcaaagcaggcgctgctttcaaaaagccctgcccaaatcatcccgcccagaaccttcttaggtttgcatcctcatttccccctcccctaatttcaatagctggaaagtaatcaagtatcccgagaaccaatttatgcactagactccaaataaataaaatatttttttcaaagtg

SEQ ID NO: 347840 - DNA, 434 bp, Homo sapiens
atcacctaccaccccacacagccaggcccccacttcctcaccaactcagacagaagattagagattttctctctggtaagattaaacagaatgactgtggacaccaggcacagctgagagaagggtttaggtgccaagctgaaaacgagattaatggaaagctgcaatgttgaacaaggaagctccttccccaacttggtttcctggacagaaatcggagaatttctctccaaggatgtgaccagtccaaaagaaaaaatctttaggagtcctccagagagaggatgcaatccacccacccattaacaagctccatcctcatgcaaaaaacttccaagcagcttttcagtgtctcactttcaaatatgatgagtcaactaaagattatcagacatatgaaaaactcttctgaaataaaagacctgcagtttaca

SEQ ID NO: 347841 - DNA, 343 bp, Homo sapiens
ggactggtctgtagtactcacaaggcgggatgcggtagcctgtacgcctgtgtgctgacacaatggtcggaattgtttcatctgtgtgtttccaggtggcttgataatgtacaatgatttcagttccagggaagaagaaggagccattcgatactcagtccactgcacccggctatacgagaactcttttaatagctaagttttccaggcgatgtagtatgaaaatcaaacccgtccatgtttgcattgactcgactctgatgtaaagacactgggttttgatcctgaactccatttcgaaattcagaaacgccgtagataaacagggcttcctgtcttcact

SEQ ID NO: 347842 - DNA, 1523 bp, Homo sapiens
gcactttggagtattgagaaagattgtcctggaaaaatacgtcacacacagttgcaggaaagagtgcctttaagcacacataaaaactcggttacttggctttgtttatgaattccacatagaaacaacagaaaattgtgccttttgaggaactgcttgagaatccttccttctgcatttcaagacaagattttaaaaatcacatatatcaaatatatggggaaatgagacacaatgtttttagagagtgtctagaaataataggactgtgcaagttagtacagcaaaattttgggtcaaagcatgggtcatttgacaaactctctttatgaacattacctctgcaatatttttctaaatgaaaacaatcacacttaatagaattaatcaggatgggagctagaagcatataattcactttccacagattggagtaaatcctcataatgcccctttcctgtgtatttagttaaaaaagcactccagtgagattgctttcgcagtaagtttctgtaaaccactgtacccttgtatttctctcctgtgtttccaagagttctcagatgctattttcgaatggcagcgttcactccagagctggctgaggtcaacgaagctaattttggtgccttggtgcccagggtgaagggagagagaagtcctctgcagagccaaaaggactctctggggcctgggtttggagcagtgtggtgttgctggacacaccacatttcacctttagaacctttatttgtgtgcttgcacaacaaatgtttacccagatattaagataaggaaagtatgaaggtcacatttcactggtgacaagagagcttctataaatgtaaccatatcgttgtgcagcgggagtctgtcttttattctgtacccgggacttagggggaattattggtgggtggggcatgggagttgaggctcttcttggttttctggctttcttgctatcactctgtttgtcttgcctcagctgatgtgcgcctcccatttggtaagggcctttgtcatggccaagacatctaaagaaatcctagtctgtgtggctgggcactgtgtggtcccctgactctctggagtcttccagagttccatggaaattagtgcccccgtgcatttccctgccgactgactggaaggcaccctggctgctgagatcgctttcctggtcccccagaagaggtccacatggtgctgatcctgcagctgttttaggcctcctcagcgggattgtcctatcctcggagcacagagaatcttcagagtgggataggggtttcttttgtggatttgggtttctcttagggatctccaaagattagctagacactcagggcctcagtaaagacatgggtccttggtctagttttcttcccaagggcagccaccatggcagtgggagttcaccttgctgactgcaagggaccccacctcacctctatcgcccattcaccatcattcactgtgcctcctgagttcctaatacacaagcctcctcccacagctca

SEQ ID NO: 347843 - DNA, 637 bp, Homo sapiens
gtgtcgaccttgtgggtcatcttgcacctttgcaaacgaggaattcccctctgtgccctgataaatcagcacctcagtggacttgccaggaggtttcctgatgtcaaatttatcaaagccaattcaaccacccgcatacccaattatcctgataggaatctgcccatggtatttgtttacttggaaggagacatcaaggctcagttgatcggtcctctggtgtttggcggcatgaacctgaccagagatgagttggggtggaaactgtctgaatctagagcagttaagacggacttggaggaaaaccctaagaagccgattgaaggtgtattgctgtcttcagtgcagagctctgtccccatgaggagggacagcgattccaagggtgactgaggctgcagctgctatcacatgctgaactttcttgtgacaaattgtctggatttctttaagaaaaggaaaagcaagaatgaatccttctggtttttagttttgtataaattatgtttcaaatctttacattttagaaataataattgctggaaattctgttaaatattttggaactctttttttaaactatagtatttcctctaaaaaaattaaaaccagctattggtatggcaaaaaaaaaaaa

SEQ ID NO: 347844 - DNA, 819 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347845 - DNA, 658 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347846 - DNA, 529 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347847 - DNA, 506 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347848 - DNA, 915 bp, Homo sapiens
  misc_feature (692)..(692): n is a, c, g, or t
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttacacaagtttaacgattaagaaagacgcacantggcgtccacccctttccaagccggaagaatagcacagctgcaacgcagcagaacaaccacactggttgcgcgccgcctgtgggccctgaaaggaagttttgaagaaccaatattgttaggagcgggggggcccaagcagggtagcgggacacgtgggccctcgcgtgtcccagaaggaaactgggcgcacaacagagcgcggactcccccaagaaaacgccg

SEQ ID NO: 347849 - DNA, 551 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347850 - DNA, 566 bp, Homo sapiens
aaaccccagctccacctttctgggatgggtgacctagtaaagtccaggcttgaatctcgggtctttacttgggcaacgggcaccatgataccctatgttctggggattagcagtgaggaatgtggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347851 - DNA, 625 bp, Homo sapiens
  misc_feature (568)..(569): n is a, c, g, or t
aaaccccagctccacctttctgggatgggtgacctagtaaagtccaggcttgaatctcgggtctttacttgggcaacgggcaccatgataccctatgttctggggattagcagtgaggaatgtggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccaannaaaaaaaatattatatatttaataattaaataaattttttccccctttccggccgc

SEQ ID NO: 347852 - DNA, 534 bp, Homo sapiens
aaaccccagctccacctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccaaaaaaaaaaaatttcattaaaaatcaaatcagttttaaaatatttaaacatgt

SEQ ID NO: 347853 - DNA, 451 bp, Homo sapiens
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347854 - DNA, 356 bp, Homo sapiens
caggggagtccacgcctgctggtggggggagcccgggagggcccgggagaagcacaaagggtgggctgtgttgagcttcttcttttcttccagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347855 - DNA, 345 bp, Homo sapiens
agagagagagggagagaagtaagaaaggctggaggtgggagcagaactcacagggaaggatctgacggcatcgcctcccatcagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347856 - DNA, 389 bp, Homo sapiens
caggggagtccacgcctgctggtggggggagcccgggagggcccgggagaagcacaaagggtgggctgtgttgagcttcttcttttcttccagtaaagaggctggagaggagctgggtgagtctggggacagggaagggggagggcaagagagatcctgagtgggtgagtggggagaagcatggctgagcgctgagaggagggttggggacgggagacaaggagagagaaagtaggagcatgagagaggcagagaaaatcgaggcaaaagagaaagagaaaatgagacagaaaccaagagaaaaagtgagacagaggataggagagacagggagaaaatgagagtgagagagacacaaagagaagagcaatgaaagagagagagagaga

SEQ ID NO: 347857 - DNA, 734 bp, Homo sapiens
acttcagccctagcagcatctgcctgtgggaagcagctctccacaccagccaagggggcccccacactcccgcgctgctctgcggctcagggagcagcccacctgctggatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347858 - DNA, 811 bp, Homo sapiens
aaaccccagctccacctttctgggatgggtgacctagtaaagtccaggcttgaatctcgggtctttacttgggcaacgggcaccatgataccctatgttctggggattagcagtgaggaatgtggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347859 - DNA, 670 bp, Homo sapiens
agcagggtacatgtgtccacagacatatgccaagatcaagaggtctcaacagatgcagtgtaagagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347860 - DNA, 762 bp, Homo sapiens
aaaccccagctccacctttctgggatgggtgacctagtaaagtccaggcttgaatctcgggtctttacttgggcaacgggcaccatgataccctatgttctggggattagcagtgaggaatgtggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctggcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347861 - DNA, 749 bp, Homo sapiens
aaaccccagctccacctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347862 - DNA, 633 bp, Homo sapiens
aaaccccagctccacctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347863 - DNA, 680 bp, Homo sapiens
aaaccccagctccacctttctgggatgggtgacctagtaaagtccaggcttgaatctcgggtctttacttgggcaacgggcaccatgataccctatgttctggggattagcagtgaggaatgtggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347864 - DNA, 766 bp, Homo sapiens
aaaccccagctccacctttctgggatgggtgacctagtaaagtccaggcttgaatctcgggtctttacttgggcaacgggcaccatgataccctatgttctggggattagcagtgaggaatgtggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347865 - DNA, 690 bp, Homo sapiens
aaaccccagctccacctttctgggatgggtgacctagtaaagtccaggcttgaatctcgggtctttacttgggcaacgggcaccatgataccctatgttctggggattagcagtgaggaatgtggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347866 - DNA, 614 bp, Homo sapiens
aaaccccagctccacctttctgggatgggtgacctagtaaagtccaggcttgaatctcgggtctttacttgggcaacgggcaccatgataccctatgttctggggattagcagtgaggaatgtggaaagtgcccagctcagggttggcacataagggaggctccccagcctgggaacgattataacagagggcccctcacttcacagatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347867 - DNA, 726 bp, Homo sapiens
aaaccccagctccacctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgatatatgtatctacgggggcctggggctgggcgggctcctgcttctggcagtggtccttctgtccgcctgcctgtgttggctgcatcgaagaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347868 - DNA, 603 bp, Homo sapiens
cacccacccaggcccaggctccttcccctccatcatccccttaccagcacctagaaccatccagggctgaaaagtcccctccaaaccacgtgatgaggaacttgaggcaagtcaccagcccctgatcatttcgcctaaaagagcaaggactagagttcctgacctccaggccagtccctgatccctgacctaatgttatcgcggaatgatggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347869 - DNA, 726 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347870 - DNA, 847 bp, Homo sapiens
gaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctggatgaggaacttgaggcaagtcaccagcccctgatcatttcgcctaaaagagcaaggactagagttcctgacctccaggccagtccctgatccctgacctaatgttatcgcggaatgatgaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccaaaaaaaaaaaaaaaaaaaaaaaaaaaaaaaaaaaaaaaaaaaaaaaaaaaaaaaaaaaataataaaaatattatatttttataataaaacatatttaattttatttttttatactgctataaaaaattaaaataaataaaaattttggccccccttggccccgtttgtttttttctcgggccagttttttcttcgggcccaaatttggagctcctttgcccatttccccttaaggggggcgatttaaattcacgggcggggttttaaaaggggggggtgggaaaacccggggtgtccccccttttttctctgggaaaaaaccccttttgcaagtggtgaaa

SEQ ID NO: 347871 - DNA, 504 bp, Homo sapiens
aaaccccagctccacctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtcccccca

SEQ ID NO: 347872 - DNA, 656 bp, Homo sapiens
aaaccccagctccacctttctgggatgggtgacctagtaaagtccaggcttgaatctcgggtctttacttgggcaacgggcaccatgataccctatgttctggggattagcagtgaggaatgatgaggaacttgaggcaagtcaccagcccctgatcatttcgcctaaaagagcaaggactagagttcctgacctccaggccagtccctgatccctgacctaatgttatcgcggaatgatgtaaagaggctggagaggagctgggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaattgatcatcatcaaaacttatgtggctttttgacctttgaatagggaattttttaaattttttaaaaattaaaataaaaaaaacacatggctcacccttccaccca

SEQ ID NO: 347873 - DNA, 2765 bp, Homo sapiens
gcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggtgggacacaaggagcaagaggcatactgtgccctattcatagacttcccaaagggcattgaaggatggaccaaagagggcatctccttgtaaatgcctggagacgatgtcccagtgcagtcctgactccctatttaacttgccccagctcggcctccttcttcccaggcctgctacattaccctccatgatgaaaagggaggggctgagacaggtctgtgttcaaatccaagctccaccacttcttccagtgaatcagtgagcataaatggagagcactctaagggccccaaaacactgtgagtggaagatgaaccctaccctcaagcagtgctggtctcccagtgatttaactctgatgaatcccagtttacccgttctgtaaaatctgaatctgaagggtattgatgatgatgatgatgatgatgacgatgacgatgatgatgatgaaatatatgcttcacatctctctctcaagcctgcatggataggacccgggttctaggtactctaagagtactatagaggatgaaatgagcctggagtagctctccatcctcatttggactgttctggaacctgcctgccagtcatttgggtttctttgtctgccagtcatcatccaatgatgattcaagatgacaaggtctggacaaatgaagataatgggagtttccttgggcaagtctcaattttttaggagccatgtagggaagactttgggatggatgagacataattgagccattgtcactggtcaaaaaggcctgggacctggagtttctggaaagagctctgaacacaaggcatctgtgacccccatgccagccctaggccagcctctctggctgtgaccccagagacttggcgtatttacctaggcctgcttcccttccttgccggcaggagttaatctttgccagccacccactctgggcaccctatgcagaggcaggtgggctgggatctcctgggcagagggaagggagggagagaaagagggagggagaaatgctctgtgctccctgggaacctgctgagctggcacttgttgctgcctggttaccgtggcgatgtgcttaatgcagcgttgaaaatacagaatactgactcctctgtccctcctggccccggactccctccctccctcccttcctcttctggagcgtgaaatgagattggtcaagataaaaaaggaaaagattcggttatttttttaagagtgtggataatggggcctctcaatcaaaatcccagtctccagtcggttccccccattccccttccaacccctccaccttcccctgccgcctgcttagaggaggaggaagaaacataaagcacaaggcttttctcttaattatgaatcattccctgagggcaggcccagggcaaggggttcctggggcccagagtctgacctgtgaggtagctagaaggcttgagcctctcatcaaagtcccccaggttgtttccagaaagaatcctgagtgggttctgtgaaaaaga

SEQ ID NO: 347874 - DNA, 2217 bp, Homo sapiens
ttctgtcgtcgtctccctgtgcgttccggtcttgcagcctgcttggcttctagttgtccagtgtcggttgtctgtgcttcctgacttgctgttcctctgtcgcctctctgtgctcctttctgtttgttttccgctcccgtcgttttttcttctttcgtgctgctctgttctcccttttgttgtcagcgtgtggttttttgctctcttgtgtttttgttattctcttgcgtctgttcccttccttcttgtcatctgtgttgttccttcctcccccatctgttccctcttccgcttgtcgttttcttgtctctttccttcttgtttttttgttttgtttgctcgtccttccctcctgttctctgtctgtgtttgacccaccccacagatccgtggctgcttaaaattttgcattacttcggggacttctctccgtttggacacccttctctggtgtggtgatggatcccccccttttttggtgccccctctgggaaccccctcatctgtgtgagttgtgcttccgcagagccgcctcctcggggtgttccccgcccggcgcgttttttaactttgggtgagaatccccgaccgcttgtgctgtgccccgcgtttctcctttgggaaccccgcttttggccccatgtctaccttccctctttggggcccctcggcgcccactacaccgagtgggttcttgaaagcctcttttcgaggggccaaggggcccaaaaattttttttttttttttttttttttttttataaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctgctggtcccgtgccagcactcgcagctgggcaggcaatctgcatcagcaattttatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtg

SEQ ID NO: 347875 - DNA, 463 bp, Homo sapiens
cactaaggtgctgatggagagacgcagagaggggtcaacgttggcaaggttcacaaggtcaaaacacagaacttgatgatgggtttgataggaaagagagggaagcagaggttaagccccatctctgttttggccttgagtgactgatggtaccaatcatgaaatgcggacaactggggaggactaggcatgcggagtagggtcacagacttgactgtggacagttgagtttcaagtgcctttgagatacccaaaaggggtgtcaaaaaggcgactgggtctggggcagccatgagttctctttcctcctcttctctctcatggcctttcttctcttcatcacagaatcatccggaccaaagtgcagcaaccattcaacctccctatggacagctgcgtggccaccaagtccctgagtcccggacacacgctgagtgagtgctgagagacctggatacacaca

SEQ ID NO: 347876 - DNA, 2618 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347877 - DNA, 4064 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttaggactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcggcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaaaaaagt

SEQ ID NO: 347878 - DNA, 2285 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347879 - DNA, 2887 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactcaaagcaaaacaacaacacacgcgggagcacacgcaaacaaaaaagtggggcgggccccaaataaactggggggggcccagaaaaagccacgcagacgcgacatgggtcccaaagcgggaagtgcacaaggggtcggtagagctctccccccggagcggcgaggggcaagcgttgtgtctgccccgcccgtg

SEQ ID NO: 347880 - DNA, 2753 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347881 - DNA, 2509 bp, Homo sapiens
accacatagctcccaatcgtaggtgagtttctgaaaggctgggtggacattcattgagtctcagggttggcaggaatctagctttgtaaatggaattatcgcataagtgaataaagggattatctgcaatttggagtcaagagccctaaggtcgagttctactctgacatttaacaacagtgtgatttgaggcaaactgcttaatcatgctgcactccagtttccttttctataaattggtagtatccatgagtacctcatggggtagtcttgagaataaaagatcataatgtatgggaaagtgctttacaaactttaagctctttaccaagcaccggtagtagctgtggtgatcagtttgactttgtttttgttatgtaagggaattcttaagtaatttcttcggtaaataattcctttggaaaactcaagaatccattaacagaaggaggtgatctgatttactttgtgtaaatttatacgttgagtttgcttaaagcggcagactcaggatggaacaacaaactactccaagtcccaggacacagcttcctgagggtgtgtgccctctggggctctccctcctctcccatccttaaccctcacacctcccctcagccccccatgcacacaaacacacacactcatacctagcgaggctaaaaggttcatatatatggatgtcctctttggcccctaaccccatacccctgctgtggggccctcccagaagagcccttctccagaaggtccaggcagcagaaggagcagttagtccctgggccctacactcacagcacagtttcccagctccaccaaaccctccagctctgggagcttccgcagatcccagaggctcagtttcttcatctggaaaatgggggtagttataacatctaccttctgggcctcctgggagggctgtagtatgtcaagccagtgcctccagtacctacggaaaaggacactgccccaaattttccagatcgatgggttccaaaagggatgacagagggaccttctgagctccattgtccctgccgtggctccaactgtctcccccaccattcctgagcttgcccattgccagccctgcagaccttcccacaccccagccctgcattgatgcccttcacctcacaggcctctcccctgtgtgcctccaacaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347882 - DNA, 2478 bp, Homo sapiens
caggtacaaatctgaggagcagtatctgtagggctatctgaggtcctgcgtggcattccttggacagtaataggtagtttcacagggattatctgcaatttggagtcaagagccctaaggtcgagttctactctgacatttaacaacagtgtgatttgaggcaaactgcttaatcatgctgcactccagtttccttttctataaattggtagtatccatgagtacctcatggggtagtcttgagaataaaagatcataatgtatgggaaagtgctttacaaactttaagctctttaccaagcaccggtagtagctgtggtgatcagtttgactttgtttttgttatgtaagggaattcttaagtaatttcttcggtaaataattcctttggaaaactcaagaatccattaacagaaggaggtgatctgatttactttgtgtaaatttatacgttgagtttgcttaaagcggcagactcaggatggaacaacaaactactccaagtcccaggacacagcttcctgagggtgtgtgccctctggggctctccctcctctcccatccttaaccctcacacctcccctcagccccccatgcacacaaacacacacactcatacctagcgaggctaaaaggttcatatatatggatgtcctctttggcccctaaccccatacccctgctgtggggccctcccagaagagcccttctccagaaggtccaggcagcagaaggagcagttagtccctgggccctacactcacagcacagtttcccagctccaccaaaccctccagctctgggagcttccgcagatcccagaggctcagtttcttcatctggaaaatgggggtagttataacatctaccttctgggcctcctgggagggctgtagtatgtcaagccagtgcctccagtacctacggaaaaggacactgccccaaattttccagatcgatgggttccaaaagggatgacagagggaccttctgagctccattgtccctgccgtggctccaactgtctcccccaccattcctgagcttgcccattgccagccctgcagaccttcccacaccccagccctgcattgatgcccttcacctcacaggcctctcccctgtgtgcctccaacaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347883 - DNA, 2216 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttcccacccagatcctctacaccacatactacgagtccatcagcaacaggggtcccttcttcggctactacttcttcaacgggcttctgatgttgctgcagcacaacacgtgcttcttacataa

SEQ ID NO: 347884 - DNA, 2014 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347885 - DNA, 1630 bp, Homo sapiens
gtgatctagcaggatgctactccacttggttgcagccccagtccagaccggcagggagctgatatcacctcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtg

SEQ ID NO: 347886 - DNA, 898 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaataggtaagagagaaagcagcctctggtgtcaggctggggcccctgggctttggggaaatcaggaaagagacaagaaaggcctggcttgggtggagcagaggccgggaaggggcctgatgctgaacaatcaggcagggagcacacctggctccaggcagatatcatacctccctgcctcctcccttgccccatgctatggggcaccctccccctggcccccagccatagtgtgctatctacagtttccttcctcaaacaccacatctgctttcattcaataaaagaatcttcatgaattgatccttttctaagccatcagacccctaacccagcccacattcaag

SEQ ID NO: 347887 - DNA, 370 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccccggcctaattattagcatcatccctctactattttttatccaaatcaacaacaacctatttagctgttcccagcttgctcaga

SEQ ID NO: 347888 - DNA, 615 bp, Homo sapiens
actttgtaggggctctgcatgtgactgtcacatgtcctgtccctcagttggccaaggctcctgggcccacgtggctggccctttttctccctccacagtgagtcagcttggagtcagtcctctactttggcctagagcatgaatagataggtcccctaaaagctttcttccttcccggggggtaccaggtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcac

SEQ ID NO: 347889 - DNA, 2697 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347890 - DNA, 843 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctgaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagctccgcctttttggatctgcagcaagtcggctccggggtcccgcccttcaatgcctttccccatgctgcctccgtgtacgggcagttcacgggccaggccctcctctcaggtacgacagggaggtcccggggccatgcagc

SEQ ID NO: 347891 - DNA, 2387 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347892 - DNA, 2508 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347893 - DNA, 2540 bp, Homo sapiens
gcacacttctatttgtttggatgtggagagagaaaagaagaaatccacgtggtgggtaaagcacctgggtccacagccgaaaaatcccgggtttagtctgtttcactatacaaaattgggccatttacctgagttccaggctccacatataaaacacagacataatattactcacccatgtcactgggctgctgggggactctactaggacaacagaggcaaagctctgatataagctctttgcaaatgtaagaagtggtccttatgtcacccagtttagggcagtggttgagagcagacacattctgatccctcgaatctgaatcctatctttggcccatctggaagtgggacaagtttcttaaacctttgtgcctgggtttcctatctggggaagaataaattaacagatgcaaggaccctgaacagtccggttggagactgctccagtccttggcaccgtcctgcattctgtgggtcccaacagtgtggtgaaaccaggaagccgaccagccatccaaccagggtgtggtcctctggctgagactctctatcccacgtctgggcacccatgccaccagctggccttgaattccagggatgcgggaggacaatgagcatgaacgaaacgtgccgagtggagttgagaacgtaaaggaagaagggggcgatgaggacctctcctggggagatgagggctgccaagtcctaagacacaggctcagggtctgcaggaaggtcggcttgttggatcgtctctgtgcgctgacttctctttgctccccaggggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347894 - DNA, 1055 bp, Homo sapiens
gcaggagtcccacggaaagagaaccatgcccctcattaaggagtcttggaggacagtttggccttgtccaaggtcatcctgtccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcaactca

SEQ ID NO: 347895 - DNA, 3071 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcaggtgagaagctgggccctgggaggtgaacagggtgggcaagggccagagaaggtctattctccaaatgagcctgtgctccatcaaagcagctggaagttgcatcaatgggctcagggcacctgccttatgcaactccaagcctgacacatgctttattttaccagatgccctggcatcttcctccctttctaaccctcctggcttccttcacccaaaacctttgagcctgggcctttcagggatggcagcacaacctgatgatgctatcccttgccatcagcgtctttcccagattgcaacatcacgttccacaactctgaagcagtagcacaaagccttcacataatgacctcagccactatttcctagccccacctttggccactcatcctgcacaccccatgctcttgcattactcatggccccgagctcaccaccctcgctcacacctctctgcccttgcacactgtgtgccctccacacagaatgcctttcctcccacttctctgcatggaaaaataccactagccttcatgactcagccaaacatcaccctctccgtcagtcctcccctgcccctccgacatgaatcatctctcctgcctcttgcccttctgcatgtcccacatgctgctctcagtagcttctcacagtgtcacttaataatctagcagacagacaggtacaaagacacgcggactccttaaggacagggaagcctcatgaaacgttaaacatcgtttttattcccagcacctaccattgtgccccccttataatagacagtaatggtatagtgaatgaatgaacaaatgaatgagttgagaaatccagaataatacatcacaagctacagcgaatttttcttgctagtgctcaggacaggtgaaatgaatcataacaggttggtgtctgtgaaaagctgacagagatgtgagaggtcccaccctgaggccaacaaagactctgcagctctggcagaaccactaagctctcagctcctagtcatcacatctttttcccttaaccctgccaagtcaaccagatgaggagtgtcttcagggtgggtctgttgcccctctttgcccatgccgtcatttgctgtaggagtgaggcaagtccatatgcctttaagaaccgagtaggacaatggagatgatgccaataatcagcccaaccacttccagtgaccgtctgggctatcagcgttgactgtggcaaccacgagcgtgcagagaaagctgaccatcagcagcatggggagagggcctggggtgctcacgcaccagtcagcacacagctccaggaaggaaaggggttgcagtggggggcctgcaggaagctcactctgtgagagtaagcctgcaaaactcagtgtgcaggcaccagccactcagtgaaagtaaagaaaccctgctgatgagactctggacacccgctgagtcccagagccatttcctggctccatccctaagccccccaaaggaccctgcttgactacagagcacccccatgccatgctggcatatgaacatggggaatcctggaatgagaaagtctttgagctttcagggacctccatgaccaccttgtccagtttctccatttgtgtggagataatccaagcaagacaaggagggcttgggcaatcagaaggttttggagctcaggcctgccaaccctcatttcattcagactggtccactgtcacctgtttcagatatggtgcttctacgtaaacacttatttgaagactgaaaaaaaaagcatttgaaaaccattaaacttctccaaccactcatctttcagatgaggagactgaggtccagcagtgtccataaattattcattacctcctcagtcaatcattattcacccagtcattcacctggagggtggtgaaggcagggagaaccagccagtgcaagggcccctcatgtcctgcctggcctttgcttttcctacctctggtaactgactgtgctgccaaagtaacactccgtgctctctcacctgggcataggaatgccctctggcttggggagccaagaaagaagcacaagtattcatacctgaccttaggacaggttgtaacacagctatcttttctgcaaaatcaacaagtg

SEQ ID NO: 347896 - DNA, 2662 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggtaaggagagggccggcaggaaggggagcactgcaaagaggaagtattggagcaaggtgggacacaaggagcaagaggcatactgtgccctattcatagacttcccaaagggcattgaaggatggaccaaagagggcatctccttgtaaatgcctggagacgatgtcccagtgcagtcctgactccctatttaacttgccccagctcggcctccttcttcccaggcctgctacattaccctccatgatgaaaagggaggggctgagacaggtctgtgttcaaatccaagctccaccacttcttccagtgaatcagtgagcataaatggagagcactctaagggccccaaaacactgtgagtggaagatgaaccctaccctcaagcagtgctggtctcccagtgatttaactctgatgaatcccagtttacccgttctgtaaaatctgaatctgaagggtattgatgatgatgatgatgatgatgacgatgacgatgatgatgatgaaatatatgcttcacatctctctctcaagcctgcatggataggacccgggttctaggtactctaagagtactatagaggatgaaatgagcctggagtagctctccatcctcatttggactgttctggaacctgcctgccagtcatttgggtttctttgtctgccagtcatcatccaatgatgattcaagatgacaaggtctggacaaatgaagataatgggagtttccttgggcaagtctcaattttttaggagccatgtagggaagactttgggatggatgagacataattgagccattgtcactggtcaaaaaggcctgggacctggagtttctggaaagagctctgaacacaaggcatctgtgacccccatgccagccctaggccagcctctctggctgtgaccccagagacttggcgtatttacctaggcctgcttcccttcctcttctggagcgtgaaatgagattggtcaagataaaaaaggaaaagattcggttatttttttaagagtgtggataatggggcctctcaatcaaaatcccagtctccagtcggttccccccattccccttccaacccctccaccttcccctgccgcctgcttagaggaggaggaagaaacataaagcacaaggcttttctcttaattatgaatcattccctgagggcaggcccagggcaaggggttcctggggcccagagtctgacctgtgaggtagctagaaggcttgagcctctcatcaaagtcccccaggttgtttccagaaagaatcctgagtgggttctgtgaaaaaga

SEQ ID NO: 347897 - DNA, 788 bp, Homo sapiens
tgggaacaaacttcagaaggaggagagacaccgggcccagggcaccctgcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtaagcacgaaattcaccgcaggccgccttccccgcagggcttgacttctccagctgatctcagggcagctagagaattcccctcccagggaacggggatttgctcccaatgtccagctttggtcctgagacctgaacagttatggtggtccttctgggcctctacccagccactatttttctactgttttcttgcccttccttctttctttgtccatttatccttcttttagtttctccctctcctttgaaaatcactaataaaaacttgctggttttgtggcttgaggggcatcatggaacctgccgacatgtgatgtctcctctggacacccagctttaaaatttctctcttttgtactctttccctttatttcagactggccaacacttagggaaacatgcgaaccggaccgagctgcgattatc

SEQ ID NO: 347898 - DNA, 2399 bp, Homo sapiens
ttttctcccttagatgccttttatgaacaagattttactagaagacatcactattactggattcttcatgaaagagcactggctgatatttatatcgggctattagctgagtggtagtctgcctggtcgcaattgcttctatagttgattgaatgctcttaacacggagagacaggataccttcaagtttctccctgttgcagtgggagtaagaagaaagatggtctaattgtttcaagtacactagcccttgtccattttcctggcaactgtcggtaggcctgtggcccacagatccaatagagaccagagggtgcttgccagatgccctgtacagacttttggggaactgggtactgatgaacccgaacaggagttgcttctggttttaattctgctactactggtgcatgatttacagctaaaccagagaggagtctgcaatgccgagtggaggaaggaggaaccggagtgtgagcagtagctgggtgggcagcatggctgggatcaccaccatcgaggcagtgaagcgcaagatccaggttctgcagcaccaggcagatgatgcagaggagtgagctgagcacctccagtgagaagctgagggaaaaaggtgggcctgggaacaggcagaggctgaagtggcctccgtgaacggtaggatccagctggttgaagaggagctggactgtgctcaggagcgcctggccactgccctgcaaaagctggaagaagcgggaaaagctgctgatgagagtgagagagatacaaaggttattgaaatctgggccttaaaagatgaagaagatggaactccaggaaatccaactcaaagaagctaagcacattgcagatgaggcagatgggaagtatgaagaggtggctcgtaagttggtgatcattgaaggagacatgggatgcacagaggaacgagctgagctggcagagtcccgttgctgagagatggatgagcagatcagactgatggaccagaacctgaagtgtctgagtgcagctgaagaaaagtactctcaaaaagaagacaaatgtgaggaagagatgaagattcttactgataatctcaaggaggcagagacccatgctgagttggctgagagatcagtagccaagctggaaaagacaattgatgacttggaagataaactgaaatgcaccaaagaggaacacctctgtacacaaaggatgctggaccagactctgcttgacctgaatgagatgtagaatgccccagtcccaccctgctgctgctccttcctctgaccctgactctgcctgaggccagcctgcccgaagctgacctttacctgagggctgatctttaacgggaaggctgctttctccttttgccaccccctcctcccctgcctctttttcaccaaactgtctctgcctcttcctggagattccagctgggctagaggctgagaacctttgcaaacaacatttaagggaatgtgagcccaatgcataatgtctttaaaaatcatgttgtgaaaaaaaaaatacataatcacttctgaaagatgcctttgtcacatcctataatcagctcacatcatttttttctgtacaagtatattttccagttatttacctgttgaccccagaatttgttagatttttaaaaaaacaatttctaaatagtttctgtttgaaactagttgcgtccagttcagatcaaggtctgcatgctttctagtctttattatttattggaaaacttcggtacctaatacaaaagtttgattgtttcagtgtgtacctggtaaagaatcagtgaccttttaccttaacatcaaaatgtagtttaaccagttaatgtatttttcagttttctttccttatgtcatctgtgaacatcttgagctgtgagctattaagtgcatgtttccctcaaggccctctggtccattctggactaatgttgaaagatgggatggattggcatggaactgttggggtgatcagacccaacaccgggctgtgggggctaagaagtccagtggagtcaaaggaatgagaaaagacaagttaagaatgcataaggtgggtccagggggccaacgctagtatggaggctgcaatagacctgagctctggaagcccacactattagtgatcaaacaaagcagcaggtggtgaggatgtggggtttgaaaggaagcagtgcatcaagcacatgatctataggtgtgtcaggttaacatttatatggaacatgttctgctacttgagatcatggggaacatattcttctagtttaagatacaatcattttatgagtctgggagtgctagaagcaaagaaccatcaagtctaggcacattccagaggccacgaggggttttatgccctgaaacctggattccatccaagcc

SEQ ID NO: 347899 - DNA, 2246 bp, Homo sapiens
ttttctcccttagatgccttttatgaacaagattttactagaagacatcactattactggattcttcatgaaagagcactggctgatatttatatcgggctattagctgagtggtagtctgcctggtcgcaattgcttctatagttgattgaatgctcttaacacggagagatgccctgtacagacttttggggaactgggtactgatgaacccgaacaggagttgcttctggttttaattctgctactactggtgcatgatttacagctaaaccagagaggagtctgcaatgccgagtggaggaaggaggaaccggagtgtgagcagtagctgggtgggcagcatggctgggatcaccaccatcgaggcagtgaagcgcaagatccaggttctgcagcaccaggcagatgatgcagaggagtgagctgagcacctccagtgagaagctgagggaaaaaggtgggcctgggaacaggcagaggctgaagtggcctccgtgaacggtaggatccagctggttgaagaggagctggactgtgctcaggagcgcctggccactgccctgcaaaagctggaagaagcgggaaaagctgctgatgagagtgagagagatacaaaggttattgaaatctgggccttaaaagatgaagaagatggaactccaggaaatccaactcaaagaagctaagcacattgcagatgaggcagatgggaagtatgaagaggtggctcgtaagttggtgatcattgaaggagacatgggatgcacagaggaacgagctgagctggcagagtcccgttgctgagagatggatgagcagatcagactgatggaccagaacctgaagtgtctgagtgcagctgaagaaaagtactctcaaaaagaagacaaatgtgaggaagagatgaagattcttactgataatctcaaggaggcagagacccatgctgagttggctgagagatcagtagccaagctggaaaagacaattgatgacttggaagataaactgaaatgcaccaaagaggaacacctctgtacacaaaggatgctggaccagactctgcttgacctgaatgagatgtagaatgccccagtcccaccctgctgctgctccttcctctgaccctgactctgcctgaggccagcctgcccgaagctgacctttacctgagggctgatctttaacgggaaggctgctttctccttttgccaccccctcctcccctgcctctttttcaccaaactgtctctgcctcttcctggagattccagctgggctagaggctgagaacctttgcaaacaacatttaagggaatgtgagcccaatgcataatgtctttaaaaatcatgttgtgaaaaaaaaaatacataatcacttctgaaagatgcctttgtcacatcctataatcagctcacatcatttttttctgtacaagtatattttccagttatttacctgttgaccccagaatttgttagatttttaaaaaaacaatttctaaatagtttctgtttgaaactagttgcgtccagttcagatcaaggtctgcatgctttctagtctttattatttattggaaaacttcggtacctaatacaaaagtttgattgtttcagtgtgtacctggtaaagaatcagtgaccttttaccttaacatcaaaatgtagtttaaccagttaatgtatttttcagttttctttccttatgtcatctgtgaacatcttgagctgtgagctattaagtgcatgtttccctcaaggccctctggtccattctggactaatgttgaaagatgggatggattggcatggaactgttggggtgatcagacccaacaccgggctgtgggggctaagaagtccagtggagtcaaaggaatgagaaaagacaagttaagaatgcataaggtgggtccagggggccaacgctagtatggaggctgcaatagacctgagctctggaagcccacactattagtgatcaaacaaagcagcaggtggtgaggatgtggggtttgaaaggaagcagtgcatcaagcacatgatctataggtgtgtcaggttaacatttatatggaacatgttctgctacttgagatcatggggaacatattcttctagtttaagatacaatcattttatgagtctgggagtgctagaagcaaagaaccatcaagtctaggcacattccagaggccacgaggggttttatgccctgaaacctggattccatccaagcc

SEQ ID NO: 347900 - DNA, 2003 bp, Homo sapiens
tgcgaagtttggggagggaggagctcgggcggccggagctggtcgctgcgcgcgccggggggagggccggggctgcgagagaggaagctctttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagtgaaagaaaggatgtcttaagagaagctgaaattttacacaaagctagatttagttacattcttccaattttgggaatttgcaatgagcctgaatttttgggaatagttactgaatacatgccaaatggatcattaaatgaactcctacataggaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttat

SEQ ID NO: 347901 - DNA, 2608 bp, Homo sapiens
tgcgaagtttggggagggaggagctcgggcggccggagctggtcgctgcgcgcgccggggggagggccggggctgcgagagaggaagctctttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagtgaaagaaaggatgtcttaagagaagctgaaattttacacaaagctagatttagttacattcttccaattttgggaatttgcaatgagcctgaatttttgggaatagttactgaatacatgccaaatggatcattaaatgaactcctacataggaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacatagttcaatttttatgtctcttttgttaacagaaaccacttttaaaggatagtaattattcttgtttataacagtgccttaaggtatgatgtatttctgatggaagccattttcacattcatgttcttcatggattatttgttacttgtctaagatgcaatttgattttatgaagtatataccctttacccaccagagacagtacagaatccctgccctaaaatcccaggcttaattgccctacaaagggttattaatttaaaactccattattaggattacattttaaagttttatttatgaattccctttaaaaatgatatttcaaaggtaaaacaatacaatataaagaaaaaaataaatatattaataccggcttcctgtccccatttttaacctcagccttccctactgtcaccaacaaccaagctaaataaagtcaacagcctgatgtgtatct

SEQ ID NO: 347902 - DNA, 1972 bp, Homo sapiens
tgcgaagtttggggagggaggagctcgggcggccggagctggtcgctgcgcgcgccggggggagggccggggctgcgagagaggaagctctttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgctggctgatgaattcggggcctcaaa

SEQ ID NO: 347903 - DNA, 505 bp, Homo sapiens
gctcctcaagacaatgattttttatctagtatgtagattttccaatcattatttacttgcaagttttccattttctttcaagatcaaatttttgcaagcagtcatgatttctatggaactttaatttgcatatataactcattttgtaaagcgacagagtctaaagataggaaaatagtagtgtgatattcaacaaatacatttaagttttaaggcattatgtttggccaggcgcagtggttcacacctataatcccagcatgttgggtggccaaggtgggcagatcacctgaggtcaggagttcgagaccagcctggccaacatggtgaaaccccatctctactaaaaatacaaaaattagccaggcatggtggtgggcacctgtagtctcagctacttcggaggctgaggcggaaagatcgcttgaacctgggagggaggttgcagtgagccgagattgcaccaccacactccatcctgggcgacagagtgagactctgtgtc

SEQ ID NO: 347904 - DNA, 340 bp, Homo sapiens
atcataattttctctataaagtgaggaaagtaagacacaaaaatgttaaaccctatcaaattggtgctattttataaaaatgagcatatgttttaaccttagtttatactgtatttcctcatggaatatttaactttctaagtgtgaaacatagtgaaatttggactaatttcattttctttcttttcacatatatatgaagaaaactgaatatcctgatgttgcttggccattgagatttcgcatcctgcatgaaattgcccttggtgtaaattacctgcacaatatgactcctcctttacttcatcatgacttgaagactcagaatatcttattggac

SEQ ID NO: 347905 - DNA, 421 bp, Homo sapiens
acctagtttataccagatatttcatatttataagctcaatctctagaaccatcctgcatgtaggtaattgttagatttcgaggatgaagctctgagacactgagagaaggtaaccaattaatatgagccaggattcaaagtctgtgtttctaaagttatttcccgttctacactgtcttttccttcagttatatgttatattctcaactctttatattttctttccatgtattttgtacaaacatataaaatgtgttagattgtattttacttctataatttcctaatcatctccagttaaagtgtatatatatttatgtattcattacagttacagagtgtttcaagtgccattcacctatgtgacaagaagaaaatggaattatctctgaacatacctgtaaatcatggtccacaagag

SEQ ID NO: 347906 - DNA, 2371 bp, Homo sapiens
tgcgaagtttggggagggaggagctcgggcggccggagctggtcgctgcgcgcgccggggggagggccggggctgcgagagaggaagctctttcgcggcgctacggcgttggcaccagtctctagaaaagaagtcagctctggttcggagaagcagcggctggcgtgggccatccggggaatgggcgccctcgtgacctagtgttgcggggcaaaaagggtcttgccggcctcgctcgtgcaggggcgtatctgggcgcctgagcgcggcgtgggagccttgggagccgccgcagcagggggcacacccggaaccggcctgagcgcccgggaccatgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacatagttcaatttttatgtctcttttgttaacagaaaccacttttaaaggatagtaattattcttgtttataacagtgccttaaggtatgatgtatttctgatggaagccattttcacattcatgttcttcatggattatttgttacttgtctaagatgcaatttgattttatgaagtatataccctttacccaccagagacagtacagaatccctgccctaaaatcccaggcttaattgccctacaaagggttattaatttaaaactccattattaggattacattttaaagttttatttatgaattccctttaaaaatgatatttcaaaggtaaaacaatacaatataaagaaaaaaataaatatattaataccggc

SEQ ID NO: 347907 - DNA, 2238 bp, Homo sapiens
tgcgaagtttggggagggaggagctcgggcggccggagctggtcgctgcgcgcgccggggggagggccggggctgcgagagaggaagctctttcgcggcgctacggcgttggcaccagtctctagaaaagaagtcagactgtgtcgtccgcccgccacgcagactggcgcgtccaggtggccgtgaagcacctgcacatccacactccgctgctcgacagtgaaagaaaggatgtcttaagagaagctgaaattttacacaaagctagatttagttacattcttccaattttgggaatttgcaatgagcctgaatttttgggaatagttactgaatacatgccaaatggatcattaaatgaactcctacataggaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaagtgactgtttttcaagaagaaatgtgtttcataaaaggatatttatatctctgttgctttgactttttttatataaaatccgtgagtattaaagctttattgaaggttctttgggtaaatattagtctccctccatgacactgcagtattttttttaattaatacaagtaaaaagtttgaattttgctacatagttcaatttttatgtctcttttgttaacagaaaccacttttaaaggatagtaattattcttgtttataacagtgccttaaggtatgatgtatttctgatggaagccattttcacattcatgttcttcatggattatttgttacttgtctaagatgcaatttgattttatgaagtatataccctttacccaccagagacagtacagaatccctgccctaaaatcccaggcttaattgccctacaaagggttattaatttaaaactccattattaggattacattttaaagttttatttatgaattccctttaaaaatgatatttcaaaggtaaaacaatacaatataaagaaaaaaataaatatattaataccggc

SEQ ID NO: 347908 - DNA, 997 bp, Homo sapiens
ccacagcagctccataatcccctccagaacattctgcaacagccccatgatcccctctagaacattccacaatagcctcacaggtcccctgtagaacattccaccacagccccatgatccccttgctcctcagagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagaggtgaagacgcccctgctgtcagccctcatgggatccctgaggggagggtccgagctgtgaggagggaagggagtgaagggcccagccagagagccaggctccatttggggaacagattgcaagggtaaggggtagctcaccaaatccctccatgggaacgggctgggagcaagcacaaaggaaaccacactggaggcagcagcccagggcagactgcaagacactggttgcccacggcctggagggctccacccagacacaagctgcactggttttctatgctgcgtaagaagcagcatggatgtaaggactgcaagcagtgcccatttatgatctcgcagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaaccattgttaagtgtatggtttgtggcattaaatacattcacattgttgtgcaaccatcacc

SEQ ID NO: 347909 - DNA, 1395 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaaccattgttaagtgtatggtttgtggcattaaatacattcacattgttgtgcaaccatcacc

SEQ ID NO: 347910 - DNA, 791 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggtgagggggggacctggatgctggccaggcaagaccctcgggggctggacaccctggggcccaaccccaagacccagggccatcctcccacccca

SEQ ID NO: 347911 - DNA, 2023 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttggtaacaggcaggtcgggcaggagtgggtggtgggtgggggtgagcaggggtgaggggtggcagggcctcagcacagggattatccctcccctgacacacacaccagccctactgtccctgtcctgcccttgcagacatgtgtcctgcccttgcagacagccgcaggcaggcagggaccaccatgagcaaccccgtctctcctcctgaggggcagcacagagcctggaggaggcctgagtggggctgaggcctggggcgagctggggtggaggggcactggctgccgggctccagggatcttctccccttcctgccccggagggtgctggcacaggggtggggctcactcccactccgtagacacaatgatcagaggtcctgggtgtctggggaagctgggctgtgcgtgtatgcgtctaccatgtgggggtgcctgtgagtgtgctggggcgtctgcagtgaaggcctcctgagaccactccacggaaacaccgggaatccctgcagctgagcctgtctctcacgggaccgggaagctggagagagccccaaccctgcccgctggggccgagctccctgctcctgcagcagtcccgtgccccacactctgagtctgccctatccacagctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaaccattgttaagtgtatggtttgtggcattaaatacattcacattgttgtgcaaccatcacc

SEQ ID NO: 347912 - DNA, 1976 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttggtaacaggcaggtcgggcaggagtgggtggtgggtgggggtgagcaggggtgaggggtggcagggcctcagcacagggattatccctcccctgacacacacaccagccctactgtccctgtcctgcccttgcagacatgtgtcctgcccttgcagacagccgcaggcaggcagggaccaccatgagcaaccccgtctctcctcctgaggggcagcacagagcctggaggaggcctgagtggggctgaggcctggggcgagctggggtggaggggcactggctgccgggctccagggatcttctccccttcctgccccggagggtgctggcacaggggtggggctcactcccactccgtagacacaatgatcagaggtcctgggtgtctggggaagctgggctgtgcgtgtatgcgtctaccatgtgggggtgcctgtgagtgtgctggggcgtctgcagtgaaggcctcctgagaccactccacggaaacaccgggaatccctgcagctgagcctgtctctcacgggaccgggaagctggagagagccccaaccctgcccgctggggccgagctccctgctcctgcagcagtcccgtgccccacactctgagtctgccctatccacagctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaagtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaaccattgttaagtgtatggtttgtggcattaaatacattcacattgttgtgcaaccatcacc

SEQ ID NO: 347913 - DNA, 2580 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttggtaacaggcaggtcgggcaggagtgggtggtgggtgggggtgagcaggggtgaggggtggcagggcctcagcacagggattatccctcccctgacacacacaccagccctactgtccctgtcctgcccttgcagacatgtgtcctgcccttgcagacagccgcaggcaggcagggaccaccatgagcaaccccgtctctcctcctgaggggcagcacagagcctggaggaggcctgagtggggctgaggcctggggcgagctggggtggaggggcactggctgccgggctccagggatcttctccccttcctgccccggagggtgctggcacaggggtggggctcactcccactccgtagacacaatgatcagaggtcctgggtgtctggggaagctgggctgtgcgtgtatgcgtctaccatgtgggggtgcctgtgagtgtgctggggcgtctgcagtgaaggcctcctgagaccactccacggaaacaccgggaatccctgcagctgagcctgtctctcacgggaccgggaagctggagagagccccaaccctgcccgctggggccgagctccctgctcctgcagcagtcccgtgccccacactctgagtctgccctatccacagctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaagtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtaccctctcgcctccctcactgccccttcccacctcctgcccctcagcctgcccagcccccgactcagatggaagggtgacccgggacaggatctctggtcttgagcctcactggctgccaacctcagggagctgctctggtgtgacagggcctgcctcctacagctgggccgcccccttacactgcagagtcctgatgcttcctggggaggggcgcccgcaccctggggcagtggggcagccgcgggtgtctccctcccaggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagaggtgaagacgcccctgctgtcagccctcatgggatccctgaggggagggtccgagctgtgaggagggaagggagtgaagggcccagccagagagccaggctccatttggggaacagattgcaagggtaaggggtagctcaccaaatccctccatgggaacgggctgggagcaagcacaaaggaaaccacactggaggcagcagcccagggcagactgcaagacactggttgcccacggcctggagggctccacccagacacaagctgcactggttttctatgctgcgtaagaagcagcatggatgtaaggactgcaagcagtgcccatttatgatctcgcagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaaccattgttaagtgtatggtttgtggcattaaatacattcacattgttgtgcaaccatcacc

SEQ ID NO: 347914 - DNA, 1893 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttggtaacaggcaggtcgggcaggagtgggtggtgggtgggggtgagcaggggtgaggggtggcagggcctcagcacagggattatccctcccctgacacacacaccagccctactgtccctgtcctgcccttgcagacatgtgtcctgcccttgcagacagccgcaggcaggcagggaccaccatgagcaaccccgtctctcctcctgaggggcagcacagagcctggaggaggcctgagtggggctgaggcctggggcgagctggggtggaggggcactggctgccgggctccagggatcttctccccttcctgccccggagggtgctggcacaggggtggggctcactcccactccgtagacacaatgatcagaggtcctgggtgtctggggaagctgggctgtgcgtgtatgcgtctaccatgtgggggtgcctgtgagtgtgctggggcgtctgcagtgaaggcctcctgagaccactccacggaaacaccgggaatccctgcagctgagcctgtctctcacgggaccgggaagctggagagagccccaaccctgcccgctggggccgagctccctgctcctgcagcagtcccgtgccccacactctgagtctgccctatccacagctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaagtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgttgctattggtccaagaggatgctcgggtagtcttcggtggctgcaggagagcgatgctgcgcctctgcccctctcctgccacctggctgcccacagagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaaccattgttaagtgtatggtttgtggcattaaatacattcacattgttgtgcaaccatcacc

SEQ ID NO: 347915 - DNA, 784 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggtgctgtgcccggccctgggctggatgctgggaacccagagtgaattcgaagtggcccggcccaggggagccaacgtgtggcccaaca

SEQ ID NO: 347916 - DNA, 744 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaagtttctgtgctgtgggaagaagtctcctttcagccgtctggggagcacagaggctgacctgtgtcagggagaggaggcggcgagagaggtgagggggggacctggatgctggccaggcaagaccctcgggggctggacaccctggggcccaaccccaagacccagggccatcctcccacccca

SEQ ID NO: 347917 - DNA, 731 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttgctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccagcacccatccttccgtcctggatgctgacctgcctggaggagggtccggcctagctgaccgtgggcaggggccaagggcgtccccgtggaaaggccagcagcttggagaggaaggaggcctccctggcccagcagagaatgagagctcggtagcagagccagccccaccttccccttgagagccagacctggcccagaaggatcccagaggggctgagcccccag

SEQ ID NO: 347918 - DNA, 1841 bp, Homo sapiens
ccagcagctcggtcctagggcgatgttgacagacagacagaggggcggatgcagcctacctcctgggcagtgagctgcggtctgaggcccctgcccagctggaaaccacagggaggggaagggaggggaggagaggagaggagaggaaccgtcatggggccttggagtcgagtcagggttgccaaatgccagatgctggtcacctgcttctttatcttggtaacaggcaggtcgggcaggagtgggtggtgggtgggggtgagcaggggtgaggggtggcagggcctcagcacagggattatccctcccctgacacacacaccagccctactgtccctgtcctgcccttgcagacatgtgtcctgcccttgcagacagccgcaggcaggcagggaccaccatgagcaaccccgtctctcctcctgaggggcagcacagagcctggaggaggcctgagtggggctgaggcctggggcgagctggggtggaggggcactggctgccgggctccagggatcttctccccttcctgccccggagggtgctggcacaggggtggggctcactcccactccgtagacacaatgatcagaggtcctgggtgtctggggaagctgggctgtgcgtgtatgcgtctaccatgtgggggtgcctgtgagtgtgctggggcgtctgcagtgaaggcctcctgagaccactccacggaaacaccgggaatccctgcagctgagcctgtctctcacgggaccgggaagctggagagagccccaaccctgcccgctggggccgagctccctgctcctgcagcagtcccgtgccccacactctgagtctgccctatccacagctgctgggcctctctgtggccaccatggtgactcttacctacttcggggcccactttgctgtcatccgccgagcgtccctggagaagaacccgtaccaggctgtgcaccaatgggccttctctgcggggttgagcctggtgggcctcctgactctgggagccgtgctgagcgctgcagccaccgtgagggaggcccagggcctcatggcagggggcttcctgtgcttctccctggcgttctgcgcacaggtgcaggtggtgttctggagactccacagccccacccaggtggaggacgccatgctggacacctacgacctggtatatgagcaggcgatgaaaggtacgtcccacgtccggcggcaggagctggcggccatccaggacgtgtttctgtgctgtgggaagaagtctcctttcagccgtctggggagcacagaggctgacctgtgtcagggagaggaggcggcgagagaggactgccttcagggcatccggagcttcctgaggacacaccagcaggtcgcctccagcctgaccagcatcggcctggccctcacggtgtccgccttgctcttcagctccttcctgtggtttgccatccgctgtggctgcagcttggaccgcaagggcaaatacaccctgaccccacgctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaaccattgttaagtgtatggtttgtggcattaaatacattcacattgttgtgcaaccatcacc

SEQ ID NO: 347919 - DNA, 1450 bp, Homo sapiens
ggcttcctaggaatgtgccgcacccgccgccctgctgccctggcattggcctaggtgggcgctgcagctccatggccccacagaggccgcttgtccaggcagggagggccgctcagggcgggtaccatgcctgctgccctctcacaggactgccttcagggcatccggagcttcctgaggacacaccagcaggtcgcctccagcctgaccagcatcggcctggccctcacggtaccctctcgcctccctcactgccccttcccacctcctgcccctcagcctgcccagcccccgactcagatggaagggtgacccgggacaggatctctggtcttgagcctcactggctgccaacctcagggagctgctctggtgtgacagggcctgcctcctacagctgggccgcccccttacactgcagagtcctgatgcttcctggggaggggcgcccgcaccctggggcagtggggcagccgcgggtgtctccctcccaggtgtccgccttgctcttcagctccttcctgtggtttgccatccgctgtggctgcagcttggaccgcaagggcaaatacaccctgaccccacgagcatgtggccgccagccccaggagcccagcctcttgagatgctcccagggtggacccacacattgtctccactccgaagcagttgctattggtccaagaggatgctcgggtagtcttcggtggctgcaggagagcgatgctgcgcctctgcccctctcctgccacctggctgcccacagaggtgaagacgcccctgctgtcagccctcatgggatccctgaggggagggtccgagctgtgaggagggaagggagtgaagggcccagccagagagccaggctccatttggggaacagattgcaagggtaaggggtagctcaccaaatccctccatgggaacgggctgggagcaagcacaaaggaaaccacactggaggcagcagcccagggcagactgcaagacactggttgcccacggcctggagggctccacccagacacaagctgcactggttttctatgctgcgtaagaagcagcatggatgtaaggactgcaagcagtgcccatttatgatctcgcagctctccagggcagaagtcgcggtgggctcagtgggtgccctgagcggggtctctcagactgacgtcaggccttggtgggctgcactctcacctggaggctccggggaagcatctgcctccaggaccattcaggctgttgacaagtcaactcctcatggctgtaggactgaggttcccaagtccttgtccctggtcctgtggtccctccaccttcaaaccagcaatggtgcattgagcaaattgtggtcaaatatacatcacatcaaatttaccatcttaaccattgttaagtgtatggtttgtggcattaaatacattcacattgttgtgcaaccatcacc

SEQ ID NO: 347920 - DNA, 400 bp, Homo sapiens
catgttggcaagaaaattcttattcagcctaaaagtataagaattcctatccatcccaccctggccctgtaaaccagctctctcagccaagaagtttgaataatccagcagtcaccaggagcctcctttgggatgaaatttgtttcctctactcccttcaacccatcgatttcctgctcctgtttccctggctctctgggagaggatagcaaagagcctgctatctgtgaccctctttctgttttgatgactcttacagactcttgtatcaggcttttggattcctatttttcttcccacctcctgcaaccacatctaccaatggattctttgatttgcatgctcagaggcagcatgggtctagataagagacctcttggccccagcccttgatttgggg

SEQ ID NO: 347921 - DNA, 3482 bp, Homo sapiens
acagagcgagactccgtttaaataaataaataaataaaccaatcacacaagcacagcaccgcagcgcaatggcaacgcccagggcggcccgcagaccccaatcccgggcccctcctggcctctgccaacgcagctccctgacccggaactttcgtggtgtcgggcgagagtttgtgcccacttcctgagagggatgggtaagaagaggaccacttccggcgagggacgggaaagacagcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 347922 - DNA, 3559 bp, Homo sapiens
acagagcgagactccgtttaaataaataaataaataaaccaatcacacaagcacagcaccgcagcgcaatggcaacgcccagggcggcccgcagaccccaatcccgggcccctcctggcctctgccaacgcagctccctgacccggaactttcgtggtgtcgggcgagagtttgtgcccacttcctgagagggatgggtaagaagaggaccacttccggcgagggacgggaaagacagcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacaggtagatgccgggggcagctctccccaggggctggggctgctcgagcccacccacccatgggcccttcctgcccccagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 347923 - DNA, 3562 bp, Homo sapiens
acagagcgagactccgtttaaataaataaataaataaaccaatcacacaagcacagcaccgcagcgcaatggcaacgcccagggcggcccgcagaccccaatcccgggcccctcctggcctctgccaacgcagctccctgacccggaactttcgtggtgtcgggcgagagtttgtgcccacttcctgagagggatgggtaagaagaggaccacttccggcgagggacgggaaagacagcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggtgtgtggtgggcggggcctcccccctgcagcgccgcccctggcacccagatcctgactgccgggcgctccctcccccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 347924 - DNA, 3651 bp, Homo sapiens
acagagcgagactccgtttaaataaataaataaataaaccaatcacacaagcacagcaccgcagcgcaatggcaacgcccagggcggcccgcagaccccaatcccgggcccctcctggcctctgccaacgcagctccctgacccggaactttcgtggtgtcgggcgagagtttgtgcccacttcctgagagggatgggtaagaagaggaccacttccggcgagggacgggaaagacagcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggtgtgtggtgggcggggcctcccccctgcagcgccgcccctggcacccagatcctgactgccgggcgctccctcccccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtggggcagtggggtcgggaggtggggcaggggcctgcaggcagcgcagcagcccccgctgaggcaccctccctcccgcccgcccccaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 347925 - DNA, 2590 bp, Homo sapiens
acagagcgagactccgtttaaataaataaataaataaaccaatcacacaagcacagcaccgcagcgcaatggcaacgcccagggcggcccgcagaccccaatcccgggcccctcctggcctctgccaacgcagctccctgacccggaactttcgtggtgtcgggcgagagtttgtgcccacttcctgagagggatgggtaagaagaggaccacttccggcgagggacgggaaagacagcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtaggtaggtgctgagcctgggggtccctgggccacgacctcagggcaggggctggttcctccgtcagctgcgctcaccccacctcaagctccgcaatggactccagccagtcgcaccaacaggccttgccttggtagctgagggtgtcaggatcacacagggccagggctccagggtgggccagacccaggactgtcctctgaggggcgggggtctcgggagtcgtgtggctcaagctctctgttcttccccccttgctt

SEQ ID NO: 347926 - DNA, 1276 bp, Homo sapiens
acagagcgagactccgtttaaataaataaataaataaaccaatcacacaagcacagcaccgcagcgcaatggcaacgcccagggcggcccgcagaccccaatcccgggcccctcctggcctctgccaacgcagctccctgacccggaactttcgtggtgtcgggcgagagtttgtgcccacttcctgagagggatgggtaagaagaggaccacttccggcgagggacgggaaagacagcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtccccatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 347927 - DNA, 3571 bp, Homo sapiens
acagagcgagactccgtttaaataaataaataaataaaccaatcacacaagcacagcaccgcagcgcaatggcaacgcccagggcggcccgcagaccccaatcccgggcccctcctggcctctgccaacgcagctccctgacccggaactttcgtggtgtcgggcgagagtttgtgcccacttcctgagagggatgggtaagaagaggaccacttccggcgagggacgggaaagacagcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtggggcagtggggtcgggaggtggggcaggggcctgcaggcagcgcagcagcccccgctgaggcaccctccctcccgcccgcccccaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 347928 - DNA, 3349 bp, Homo sapiens
acagagcgagactccgtttaaataaataaataaataaaccaatcacacaagcacagcaccgcagcgcaatggcaacgcccagggcggcccgcagaccccaatcccgggcccctcctggcctctgccaacgcagctccctgacccggaactttcgtggtgtcgggcgagagtttgtgcccacttcctgagagggatgggtaagaagaggaccacttccggcgagggacgggaaagacagcggcttccggcgcggcggttccggacaaccgtgcgcttttagtaaaagattggggttcgcgcgggggagaagggctgccccgggccctctggttctcgtcccgcagcgtccgctcccccgcgccactgcgccgctcccaggaaccctgtactccggggtcgccggcttctctcctgcctccggtcccgccagacacctcgagctccttaagtagctcggtccttgacgtccctctgggcccttcccgcgtctatcgcctgagtccccgggcccctctagccctctgttccctcccctcttttgttcctccctagagccccgccgccctcagggctgacagtgtggacggcgggagtctcctcgctcccctgctgggattgactgaccgagcgtttagtgactgcccagatctggctgatgggggtaccgagaggtggcctgggccgggaatgtccagctagagtcttccgtggaagtcagacatgaaactgacaggcctaagggaagctaggaagtcccctcaccgctcagccagggtgatgggctggactgacagactccagtgaatttgagcttgcctgtcaggctgattggctgatagacagccctggattggctcactaagactgaccagcccgggaccaagcagttctggggtcccaacctgggtggaaggtctgaactgatgacccacccaggctgaccaggccagcccacctcactgacctcctgacccctgacctcatcacctgtgcagccatggagaagatgtcccgtgtgaccacagccctgggtggcagcgtgctgacaggccgcaccatgcactgccacctggatgctcccgccaatgccatcagtgtgtgccgcgacgcagcccaggtggtcgtggcaggccgtagcatcttcaagatctatgccatcgaggaggaacagttcgtggaaaagctgaacctgcgtgtggggcgcaagccttcgcttaacctgagctgtgctgacgtggtctggcaccagatggatgagaacctgctggccacagcagccaccaatggcgtggtggtcacgtggaacctgggccggccatcccgcaacaagcaggaccagctgttcacagaacacaagcgcacggtaaacaaagtctgcttccaccccaccgaagcccacgtgctgctcagtggctcccaggatggcttcatgaagtgctttgacctccgcagaaaggactctgtcagcaccttctcgggccagtcggagagcgtgcgggacgtgcagttcagtatccgggactacttcaccttcgcctccacctttgagaacggcaatgtgcagctctgggacatccggcgtcccgaccggtgcgagaggatgttcacagcccacaacggacccgtcttctgctgcgactggcaccccgaggacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 347929 - DNA, 1852 bp, Homo sapiens
ggtttgggtggaccttcttcccacaggggctggttggccactggagggcgcgacaagatggtgaaggtctgggacatgaccacgcaccgtgccaaggagatgcactgtgtgcagaccatcgcctcggtggcccgtgtgaagtggcggccagagtgccgccaccacctggccacgtgctccatgatggtggaccacaacatctatgtttgggacgtgcgccggcccttcgtgccagctgccatgtttgaggaacaccgagacgtcaccacgggaattgcctggcgccacccccacgacccctccttcctgctgtctggctccaaggacagctcgctgtgccagcacctgttccgcgacgccagccagcccgtcgagcgcgccaaccctgagggcctctgctacggcctcttcggggacctggccttcgccgccaaggagagcctcgtggctgccgagtcggggcgcaagccctacactggcgaccggcgccaccccatcttctttaagcgcaagctggaccctgccgagcccttcgcaggcctcgcctccagtgccctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtggcgcaaacgtggaccatgctgcggatcatctactgcagccctggcctagtgcccactgcaaacctcaaccacagtgtgggcaagggtggctcctgtggcctcccgctcatgaacagtttcaacctgaaggatatggccccagggttgggcagtgagacgcggctggaccgcagcaaaggagatgcacggagcgacacagttctgctcgactcctcggccacactcatcaccaatgaggataacgaggaaaccgagggcagcgacgtacctgccgactacctgctgggtgacgtggaaggtgaggaggacgagctgtacctgctggatccggaacacgcgcaccccgaggaccctgagtgcgtgctgccgcaggaggcctttccgctgcgccacgagatcgtggacacgcctcccgggcccgagcacctgcaggacaaggccgactccccgcacgtgagcggcagcgaggcggatgtggcctccctggcccccgtggactcctccttctcgctcctgtctgtctcacacgcgctctacgacagccgcctgccgcccgacttcttcggcgtgctggtgcgcgacatgctgcacttctacgctgagcagggcgacgtgcagatggctgtgtctgtgctcatcgtcctgggtgaacgggtgcgcaaggacatcgacgagcagacccaggagcactggtacacttcctacatcgacctgctgcagcgcttccgcctctggaacgtgtccaacgaggtggtcaagctgagcaccagccgcgccgtcagctgcctcaaccaggcctccaccaccctgcacgtcaactgcagccactgcaagcggcccatgagcagccggggctgggtctgcgacaggtgccaccgctgcgccagcatgtgtgccgtctgccaccacgtagtcaagggtctcttcgtgtggtgccagggctgcagccacggcggccacctgcagcacatcatgaagtggctggaaggcagctcccactgtcccgcaggctgcggccacctctgcgagtactcctgacggggcatctgctgggcttgcccgggcggccgcgtgcagaaccccgcctggtcttgtgcccgagacgggcggaggctggaacttgagacctcaataaaggaagtagagccgc

SEQ ID NO: 347930 - DNA, 317 bp, Homo sapiens
ttttttttttttttcagatggagtctcactctgtctcacccaggctggagtgcagtggcacacgatcttggcttgctgcagcctccacctcctgggttcaagcaattctcctatcttagcctcccaagtagctggtactacagatatgaagaagctgaagtccggaaaaaacttgaggaaaaagacaggcaggaggaagcacagcggctacaacaaaaaaggcaggaacaaatcacaatggtggaatgtcatcagttaaggcaggaaccggcccttttcacttcttttgtcttcactgcttcaggcatctgatgata

SEQ ID NO: 347931 - DNA, 272 bp, Homo sapiens
cttaacttttaaatttcctttattgtcttttgtaacaacttttatttgcacaggtcaaatttgttggggcataaaggtgaagtggcagaagaatttggtataatcatgaaagccctgtgccacactctgtgctgtcattgttcacttgtctatgcttctcactagatcacaagctttgggaaggcaggaactcttttgtgtagattgctgttgaatcactggtgcctgcagagtgactaactaaataggtgctctctgacattattgaagaa

SEQ ID NO: 347932 - DNA, 4888 bp, Homo sapiens
gggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347933 - DNA, 4586 bp, Homo sapiens
gggggtgagctgggctggcttccgtcctggtagccaaggctaattctccctcgagttcttgggagatgggcatttggcgagaaggctggcgttagtgaagcgcgcccggcgtcacggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347934 - DNA, 4743 bp, Homo sapiens
gggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347935 - DNA, 5062 bp, Homo sapiens
gggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcagtaagtatctctttgaactgaagactttttgtttcaaagcaagtttaaaaaaagttttaagtggtttcctacctcatggaagagtaagaacaacataaagctttgaaactattggcgtattttaaataacaattttaactgaattgatttttttttctatcttgtttggcacagaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347936 - DNA, 4229 bp, Homo sapiens
gggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagtggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347937 - DNA, 3829 bp, Homo sapiens
gggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcaccaaaatggttctatgggagaaaggaatgtcaaacttagtattcacatatgaacactaactactggaacagaaatgatagggccaagagatgctttttaaattgtcccttattctaaattaaaaggaagtgataattttgttgttaaatcatgcatatagcctgactgctatattgcttctcatttcattgtaactacttatatgttgtgcccattgactatcatctgtgaataaagaaagacaatatttagcagca

SEQ ID NO: 347938 - DNA, 657 bp, Homo sapiens
gattctggaagtataaacattctataagtgattacacatttgctaaaatttttaatgctgaatattttcaaaattatgaaataaccatattacaccaaccaagatatcattgttttgatgtttaaaggagcagaatatgccagaataatggaatgaatgacattattttagtcagtagtctcctactctcaatttctggctctagttttctctgaagtacaagcttgactcgagagcagctgtcattctttcttttgtggtggtcagcattataaacatgtgggtcttaccttcctagaagactcatgtagcagttgtagctggaccagagtatagtcctacctctaccattctggctgtttgaccttaggcacatcattaaatatccatatgcctcagttttcttgtttgtaaaatggaaatgaagccaaatgtctttaacaggttcctctactactaaaattccaagtctttgtatttgaaatggattttacagtcctggctaaaaatctagatgttaatgaatgaggattcatcctggtatcttcctctgtcagtgtaattgtaatgttttgttctgcagtttttcctacgatggcaggtggaaacaaaaattacagacatctgtggacttcccgttagaaaatcttgacttgt

SEQ ID NO: 347939 - DNA, 643 bp, Homo sapiens
gaaatgtaagtactgtgtatggggtttgctattctaaaaaacatttttatttttggaattttagtggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacaggtatgttcttgattttaacattattctcgcttttgttttaatattaaatatatagtatagctgggcacagtgcctcacgcctgtaatcccagcactttgggaggctgagaggggcagatcacctgaggtcaggagtttgagaccaacctggccaacatggtgaaacccccctctctactaataatacaaaaattagctgggcatggtggtgggtgcctataaatccagctgtttgggaggctgaggcatgagaattgtctgaacccaggaagcggaggttgcagtgagtcgagattgcaccactgcaccccagcctgggtgacagcaagactctgtctcaaaaaaaaaaaaaaga

SEQ ID NO: 347940 - DNA, 4813 bp, Homo sapiens
gggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaagccatttaagattaaaggacaaccagaaagtggaattctaaggacaggaacttttagagaggatacagacgataccgaaagaaataaagctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347941 - DNA, 4926 bp, Homo sapiens
gggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaagccatttaagattaaaggacaaccagaaagtggaattctaaggacaggaacttttagagaggatacagacgataccgaaagaaataaagctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaaattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347942 - DNA, 4762 bp, Homo sapiens
gggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaagccatttaagattaaaggacaaccagaaagtggaattctaaggacaggaacttttagagaggatacagacgataccgaaagaaataaagctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347943 - DNA, 4434 bp, Homo sapiens
gggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcaacaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgaga

SEQ ID NO: 347944 - DNA, 1828 bp, Homo sapiens
  misc_feature (11)..(11): n is a, c, g, or t
  misc_feature (18)..(18): n is a, c, g, or t
  misc_feature (22)..(22): n is a, c, g, or t
  misc_feature (24)..(24): n is a, c, g, or t
gactatagacnatccccnagtncnctacatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347945 - DNA, 1874 bp, Homo sapiens
tagaaccatgacgtattagtgcgccgctgcgtccacagatcatgtaaagtgtagcataggtctgtactcgtgcttgtcctcagcgaggactccttgcgatctgtgatctagttgctttgtgagttctctaccacatagaatcaatgcccggtcgtgcaaccagagctgtccttgaactgatatccagaatggtctttcgtgagtgtcgattgactgtgcatctatcaagtcgtgtgtccaatacggatcctcgatagtcaaattgtacgctcccggcgattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccact

SEQ ID NO: 347946 - DNA, 623 bp, Homo sapiens
ccaggcgactctagaggatccgggctccacttggttgcacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccaggtatggggggacatcggaaggggtgtcagggacatttgcgtgcttattgtcctagacatgtacctaattagctatgagatcttaaacagttacccactttactgcattctctgcaaataagggtgattactttaaaggtgcagtattacatggatttcacagatattgggaatc

SEQ ID NO: 347947 - DNA, 1106 bp, Homo sapiens
ccaggcgactctagaggatccgggctccacttggttgcacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgta

SEQ ID NO: 347948 - DNA, 1727 bp, Homo sapiens
  misc_feature (1557)..(1557): n is a, c, g, or t
  misc_feature (1559)..(1559): n is a, c, g, or t
  misc_feature (1563)..(1563): n is a, c, g, or t
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggcangnttgnggtcatttcagtcaccgtcctgtagggagagtataattcctcttgcgcggcacccttttttcattcacacttttttggcgctgctgtcagcgcggcggtgttcgccgactgcccgtcgtctgcccctggagggccaccatgtaagggcgcggccccgcccgcgg

SEQ ID NO: 347949 - DNA, 1506 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtaaaaaaaaaaaaaaaaaaaaaaaaaaaaaaaaaaaaaaagggggggggcgacgcactaagaaataaccccagggagggcccgaaatgtagccgccacaccccgtcttttgtcgacagaggcgcccccaaaagggagcgcggattaaaaaggcaaaaggacgggcgcgcggtaaaaaaaacgcgcggggggcggaacaacggggccggggactctggagaaagaccgccttgcgggcgggcacaaactgcggaccaccaccccagagatataggcgccagggacaaaaacactggggggtagcggtcaacccacggataggcttcgggagagccggccacggatatggaaat

SEQ ID NO: 347950 - DNA, 1313 bp, Homo sapiens
  misc_feature (82)..(82): n is a, c, g, or t
  misc_feature (320)..(320): n is a, c, g, or t
acaattacccaccactggatttgactcagagaggacccccagaggtgtctccatcttccctatttattttcagcccttgagngttccattgtagatcaaagccaaggcccccaggaaggtgacatactcctggaagttcacctcctggtccttgttccggtccaagtcttccatcagccttgcaatttcagcatcctgcagcttcgagccaatggtgagctccttctggatcagctccttcagctccttcttgctcagggtgtgcttgtcaccctccctgccggagtacttgtggaagatggccacgaggaggccaatgntgaatccagggggcatgccatggctgagctcgtgccgaatgcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgta

SEQ ID NO: 347951 - DNA, 728 bp, Homo sapiens
tcgaggatctcctcatatcgaatcagatatgtggcgaaaaagaagctggaagcgcagagctgtgatattccttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgta

SEQ ID NO: 347952 - DNA, 1054 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgta

SEQ ID NO: 347953 - DNA, 1404 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtaaaaaaaaaaaaaaaaaaaaaaaaaaaaaaaaaaaaaaagggggggggcgacgcactaagaaataaccccagggagggcccgaaatgtagccgccacaccccgtcttttgtcgacagaggcgcccccaaaagggagcgcggattaaaaaggcaaaaggacgggcgcgcggtaaaaaaaacgcgcggggggcggaacaacggggccggggactctggagaaagaccgccttgcgggcgggcacaaactgcggaccaccaccccagagatataggcgccagggacaaaaacactggggggtagcggtcaacccacggataggcttcgggagagccggccacggatatggaaat

SEQ ID NO: 347954 - DNA, 1730 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgcttaagatatgcaagatatgagataacctataaccaccagtgcactaacatgacgagcggaaatcgagcagaagaaggaaactcaacaacaagaagaaaaaataatatgatgaagcgaaataggagataagaaaaagcagtaataaaacacaatctctaaattggtatcacgtggtccaactgaactatagtatcaacgtagtcacacacaccaggaaacaaagagaaaaaacccacgtgagacgaaacacaaaggcacgggacgagagccaaccaactaaacaaagcagaccggagggagagaccaaaacgcgcagcccagacacaggaccacagctagacacgccacaggacacaacaacggcagccaacaccacgggctagacccagccgcacccccactacacaattacgacggagcgcgagaagagaaaagaagcagagagagaaagaaaaagaaggagaaagacgaagggacaggaagagaagggggggagcgagggagagaaggagaggcaccaggacagagagaaggggcggagacagacactgcgaaacgcacgcgaagaaggggaaagaggagagaaagcgaaacgaagacgggtcggagagaagcctagcaagcagagctgagcacagagactacagaagaaactgacagcgctgcaggcgaagacaagagacacgaacgaacgcgaaggaagggagagaagcgagaacggcgggcgcggagacggggagccgagcgggagc

SEQ ID NO: 347955 - DNA, 543 bp, Homo sapiens
tgaggcctccttatcagagtgtcttactgagaagcccagaccaacttctgttgtttatagtacaactgcatggaattggttgacttacctctctgtgctttctgtatcctcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagaggg

SEQ ID NO: 347956 - DNA, 1028 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagtttcttctccatctcctgaacttgatgtctgaaacatggtagtgccaggggttgcaacctgctgtgtggtagttgtagaagtttcatttccagaaactgcaggaggagaagaaaacaattcacactgcatttgcatatcctcattggtagacaatgcactcatcatgtgagaagtctgctggtaaactggcgattgctgaaggtttccatttgctgaagcagttgaagggaataactctgactgaatctgggcagctgcctggcagatactctgttgcatctccatcaccattgcggctgaagattccatcacttgctgttgctgctgctgctgctgctgttgattagataacgtgttttcagactgtggatgaacactttcagctcttccaggtaataaattatctggtctggtatggactgttggctctgttgaggaaaacattccagggcttacaccactctgaatttgactgacttgttgaaaaatatctgcactaagctgctcttgaacattctcattaccatc

SEQ ID NO: 347957 - DNA, 1156 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgta

SEQ ID NO: 347958 - DNA, 1840 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagagaatagcttgaacccaggaggtggaggttgcagtgagccaagatcgcgccattgcactccagcctgggcgacacagcgagactccgtctcc

SEQ ID NO: 347959 - DNA, 1844 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgcttaagatatgcaagatatgagataacctataaccaccagtgcactaacatgacgagcggaaatcgagcagaagaaggaaactcaacaacaagaagaaaaaataatatgatgaagcgaaataggagataagaaaaagcagtaataaaacacaatctctaaattggtatcacgtggtccaactgaactatagtatcaacgtagtcacacacaccaggaaacaaagagaaaaaacccacgtgagacgaaacacaaaggcacgggacgagagccaaccaactaaacaaagcagaccggagggagagaccaaaacgcgcagcccagacacaggaccacagctagacacgccacaggacacaacaacggcagccaacaccacgggctagacccagccgcacccccactacacaattacgacggagcgcgagaagagaaaagaagcagagagagaaagaaaaagaaggagaaagacgaagggacaggaagagaagggggggagcgagggagagaaggagaggcaccaggacagagagaaggggcggagacagacactgcgaaacgcacgcgaagaaggggaaagaggagagaaagcgaaacgaagacgggtcggagagaagcctagcaagcagagctgagcacagagactacagaagaaactgacagcgctgcaggcgaagacaagagacacgaacgaacgcgaaggaagggagagaagcgagaacggcgggcgcggagacggggagccgagcgggagc

SEQ ID NO: 347960 - DNA, 1118 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgta

SEQ ID NO: 347961 - DNA, 1042 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgta

SEQ ID NO: 347962 - DNA, 1168 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtcttgctctattgcccaagctggagtgcagtggctcaatctgggctcactacaaccttcgcctcctggattcaagcgattctcctgtctcagcctcccaactagctaggattacaagcacacaccaccacgcccagctaatttttttatttttagtagagacagggttttgccatgttggccaggtaggtctcaaactcctgacctcaggtgatccactggcttggcctcccaaagtgctgggattacaggtgtgagtcaccacatctggccttgttccaattttatttaagtctagtcccaccaaaaacagtccaaaatgtctccaggccagacattaagtttgtcagatatgttccatcttgttaattcaataataatcttctagtcaacttcaatttagtagtacattataaatgaaaatatcagattaatctttttctcctcctaag

SEQ ID NO: 347963 - DNA, 843 bp, Homo sapiens
ccgcccttgtaggctgtccacctcaaacgggccggacaggatatataagagagaatgcaccgtgcactacacacgcgactcccacaacacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacctctggagttgggcaggcctctggagttgga

SEQ ID NO: 347964 - DNA, 327 bp, Homo sapiens
taggacgactgatttctgggagacgctctcagtagggcagagaatgtcattcagccctaccttggtaactctaaagagaggagtcctagaatctcttttttgggtttgaggacccttcatccctttgagaaactaagaaaatctagactcccagaaaaatctacacaaaaaatacaaaattgtgcatataatctgagagcagtgtaaatgttctttataattaaaaaaaatttttttttggccaggcatggtggcacacacctgtaatcccagcactttgggaggccaaggtgggtggatcacgaggtcaggagttcaagaccagcc

SEQ ID NO: 347965 - DNA, 312 bp, Homo sapiens
actctctggagcagaaagtggagtggaaaatagggaagaaggtggcaaagacaagcttgagaaggaagttttttcctctttggggactcctgcagtatatgctaaaggagcaaacttcctgtgttatgctttcctgatcaaataaataaaatataattgccctgcttctccttgattcagtttagatgggggaagccagtgagagttgctgccaaagaaccttcttattccttcagggattctatccctcagacaatccagtaggtttgagcatcgggactccagtttttagggtggagacacaatccagct

SEQ ID NO: 347966 - DNA, 867 bp, Homo sapiens
ccagctgctcgggaggctgatgcaggagaattgcttgaacccaggaggcggagattgcattgggccgagaacgtgccactgcactctagcctgggagtgacagagcgagactctgtcccaaaaagaaataatcaaccaatcaatcattgcccttcccttcccgtatttgaacccctttgtcagaggagaaaaccctgcatctcttgtgccttcccaggcctgaccctgtcttctcctcgccccaggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagtaagtgaggtgcctctggtgtgagcgcacccaagcccacaggcacctgcctctcccccacctgccctgtgcccgaccctgaacctgcattgggccacacctcccctggagtcccttgagtgagaaccctagctttctcagaaccagcgtttaaagcaggggtctgtgacacaggcccctgtcccatgccaaaaaaagaaaaaaaaaaaaattactgatgaatttggtgaatgcatttctggggacggggtccgtaactcccatcagactctcaaaggaatgtgtggccctttgtgtccccaactccttccagagctctgtggtctggccttttctcttcagattaccagagacttaattctcagagcctcccgctctgctctgaggagagttaggaatgtgtcctctgcttccttggatccataaa

SEQ ID NO: 347967 - DNA, 725 bp, Homo sapiens
tgtaatctcagcttctggggaggctgagacatgagaatcgcttgaacccaggaggcagaggttgcagtgagttgagatcacaccactgtactccagcctggatgacagagtgaaactgcgtctcaaaaaaaaaagaaagaagaaaatgttatatgacagtgagatccctgtccagtattctgcagaaaggggccctggagagcctatgtagaactttgggtgttgtcacagaagcattattttgtcacgaaaattctccagcagcaagcttttagcaaaagcaaggtttgagaaaagtactacgtggaattattataaaagcagtttcatcctatttgcattttacatgccatttgtccacgctaaagctttttcccctgcagtaattctttgtccattttcctgtctgaattccggtctaactgtgctctggtcttatccttcccagcttaagtgagagctttttcatggtgaaaggcgcagccctcttcttacaacagggaagcagccctcaaggccagcggagtcttcagcacccccacaagcatgcaggtgagggctctaagttgatactcttacattggagcttcttttctggacagcagaggaaacttccattgttggtgatgttgctgagtttgaaggccttagacatagtggacgcaggtttgcagtgaccagtgcaggcagaggctcagatgctctctcttgagcagaccacgcac

SEQ ID NO: 347968 - DNA, 1191 bp, Homo sapiens
acgtctgtggcgccctcgcaccgcgccgcagccatggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagtaagtgaggtgcctctggtgtgagcgcacccaagcccacaggcacctgcctctcccccacctgccctgtgcccgaccctgaacctgcattgggccacacctcccctggagtcccttgagtgagaaccctagctttctcagaaccagcgtttaaagcaggggtctgtgacacaggcccctgtcccatgccaaaaaaagaaaaaaaaaaaaattactgatgaatttggtgaatgcatttctggggacggggtccgtaactcccatcagactctcaaaggaatgtgtggccctttgtgtccccaactccttccagagctctgtggtctggccttttctcttcagattaccagagacttaattctcagagcctcccgctctgctctgaggagagttaggaatgtgtcctctgcttccttggatccataaa

SEQ ID NO: 347969 - DNA, 858 bp, Homo sapiens
acgtctgtggcgccctcgcaccgcgccgcagccatggccctggtgaccctgcagcgctcgcccacgcccagcgccgcctcctcctcggccagcaacagcgagttggaggctggcagcgaagaagatcgaaaattaaacctcagcttaagtgagagctttttcatggtgaaaggcgcagccctcttcttacaacagggaagcagccctcaaggccagcggagtcttcagcacccccacaagcatgcaggtgatctgcctcaacatcttcaggtgatgatcaaccttctgcgttgcgaagacagaatcaagctggcagtgcgcctggagagcgcctgggcggaccgggtccggtacatggtggtggtgtacagcagcgggcgccaggacaccgaggagaatatcttgctgggagtggacttttccagtaaggaaagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagcccactgaaggggaaaggaccgagcgcctcatcaaagccaagctccgaagcatcatgatgagccaggatctagaaaatgtgacttccaaagag

SEQ ID NO: 347970 - DNA, 1082 bp, Homo sapiens
ggtgcttgcctatgtacccccaagtacacatgtggcctccgccagcagagcaccagccctgggcagctgcctccctgctgtagagtgggcgtgcggtcagcccacactgcacccaaaagcctcagctgagcacttacggagttgtgtccacagggccatcccagacctgtgtcttctagaattcatcagtgaacggttcctatgcagacagcctactcccacacgtacgtccaacagcccgtcctggaccaggtggtgagctggaaaggctgtacacgtaggtgggtagacgctgactccacatgtcttctctcccccatcgcagtaaaagctgcaccattgggatggttctccgactgtggagcgacacgaaaatccaccttgatggagatggtgggttcagcgtgagcacagcaggaaggatgcacatatttaagcctgtgtctgtccaggccatgtggtctgccctgcaggtgcttcacaaggcctgcgaagtggcccggaggcacaactacttccccgggggtgtagctctcatctgggctacctactatgagagctgcatcagctccgagcagagctgcatcaacgagtggaacgccatgcaggacctggagtctacgcggcccgactcccccgcgctatttgtggacaagtaagtgaggtgcctctggtgtgagcgcacccaagcccacaggcacctgcctctcccccacctgccctgtgcccgaccctgaacctgcattgggccacacctcccctggagtcccttgagtgagaaccctagctttctcagaaccagcgtttaaagcaggggtctgtgacacaggcccctgtcccatgccaaaaaaagaaaaaaaaaaaaattactgatgaatttggtgaatgcatttctggggacggggtccgtaactcccatcagactctcaaaggaatgtgtggccctttgtgtccccaactccttccagagctctgtggtctggccttttctcttcagattaccagagacttaattctcagagcctcccgctctgctctgaggagagttaggaatgtgtcctctgcttccttggatccataaa

SEQ ID NO: 347971 - DNA, 416 bp, Homo sapiens
tgaggaaagggcacggctgtttagaagtagctaggtttcctggatatctttatctttttccagtaccggggtagaaaatgtgagactgccgcccgaggcgtgttgacagtggtgcctgtggtgtgatattctctttctttctctgtagttggaggctggcagcgaagaagatcgaaaattaaacctcaggtaagcagactttcaattcttgttcctaagtctttctcccaagcaggtaaggaatgctcttgttcctctcccaaagggaaaacgttcaaaaagaatatgccaattttgggctgggtgcggtgggtcacgcctgtaattccagcactttgggaggctgaggcgggtggatcacaaggtcaggagatcgagaccatcctggccaacatggtgaaaccctgtctctacta

SEQ ID NO: 347972 - DNA, 516 bp, Homo sapiens
ctcagactggtctcaaactcctgggctcaaactattttcttgccttggcctcccagattgctgggattccaggccagagccactgtgcctggcgtaagctctgcttattagtaaatagtgtgaatggatcagcagccactcaacatgcggtgcaagaagcagagttcaattctctgctcactttaaaccacttatcgaaaggaaaagatcattaatgagtgatactcagtgagtttggtggactgggttgaagtttacctttatttagcaaactctttcttcatccctagtataaattattaggggaaagacatgcctaagaggacacactatttctaggacacgtctatttatatgattggcataatcacaaatcatttctatgtaagcaatactttgtgggcataactttacctataaatagacccttcaaatcaatttttgttaactctggctatcttttacttagcctaatttgtactcaacagacttctggcaaataaacatctgaaaatt

SEQ ID NO: 347973 - DNA, 1818 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattctttttttt

SEQ ID NO: 347974 - DNA, 3013 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtccggaaaactcaaatatatgtgaggtgtgcaacaaatggggacggctgttctgctgcgacacttgtccaagatcctttcatgagcactgccacatcccatccgtggaagctaacaagaacccgtggagttgcatcttctgcaggataaagactattcaggaaagatgcccagaaagccaatcaggtcatcaggaatctgaagtcctgatgaggcagatgctgcctgaggagcagttgaaatgtgaattcctcctcttgaaggtctactgtgattcgaaaagctgctttttcgcctcagaaccgtattataacagagaggggtctcagggcccacagaagcccatgtggttaaacaaagtcaagacaagtttgaatgagcagatgtacacccgagtagaagggtttgtgcaggacatgcgtctcatctttcataaccacaaggaattttacagggaagataaattcaccagactgggaattcaagtacaggacatctttgagaagaatttcagaaacatttttgcaattcaggaaacaagcaagaacattataatgtttatttagccattcttatctcctcccttcagatcctctggcagctagctacgcaatgtgcctgtggtcccactaatctgtgactgctcctgtggaaactccacatcacaattctccaaaatttatcattgccattttaaaaccgtcttttcagctttcaataaaattcaacaccccttcatgttaaaaattctcaataagctaggtattgaggaacatatcccaaaataataagagccatttatgac

SEQ ID NO: 347975 - DNA, 607 bp, Homo sapiens
tgattttgcaattagggctaaaggattgtgggtctgtgctccatttgatagtaatctctttcccttagatgggaagagacagaaatgatcctcatagaatatttatagtccaaattctgtcaacagtgtaagcagtcataagatttatagatcttttagttagatattattgatttggttttcctttactttctagctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattctttttttt

SEQ ID NO: 347976 - DNA, 593 bp, Homo sapiens
tggccaaggcccctgtcatccaggggtgcagctgacccagtcccctactctcaaggctggagtctgacttcagtaattaggtagcatctgccagctccaggtggcctttgcattgagacctagaaggggtctttaactcctacgttacagagaccaaaaagggattaggggagaatggcaaaatccatacctcgatttctgaaataaacttctaatttcttcctgccaggaactggtgaaaactcttttcgaagcctgacttggccaccttcgggttccccatctcatgctggtttgttcctgtttactactctttgagcctctgctattcttgcccctttctggaatgtgctgtggggttgcctctttgtgttaatgattgtccagaattttcaggttttacatctacagtttttccatttctgggatttaaataacaagtccttatcctctaggttgcctaggagggtttcttcctcccacaccccttaatcacacagatctcatggaaatgttgacttatatttgacatttattataaaggatacaactcaagaagagccaagtggaagaaatgcatagggcaaagcgtg

SEQ ID NO: 347977 - DNA, 1990 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttagtatagtt

SEQ ID NO: 347978 - DNA, 1906 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttagtatagtt

SEQ ID NO: 347979 - DNA, 1913 bp, Homo sapiens
aggtcagagcagcttctgagccagcagcctagggtggaagatggcggtgggggcgggaccttgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttagtatagtt

SEQ ID NO: 347980 - DNA, 3583 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtgaggagcataagaagaagaacccagatgcttcagtcaagttctcagagtttttaaagaagtgctcagagacatggaagaccatttttgctaaagagaaaggaaaatttgaagatatggcaaaggcggacaaggcccattatgaaagagaaatgaaaacctatatccctcctaaaggggagaaaaaaaagaagttcaaggatcccaatgcacccaagaggcctcctttggcctttttcctgttctgctctgagtatcgcccaaaaatcaaaggagaacatcctggcctgtccattgatgatgttgtgaagaaactggcagggatgtggaataacaccgctgcagctgacaagcagttttatgaaaagaaggctgcaaagctgaaggaaaaatacaaaaaggatattgctgcatatcgagctaaaggaaagcctaattcagcaaaaaagagagttgtcaaggctgaaaaaagcaagaaaaagaaggaagaggaagaagatgaagaggatgaacaagaggaggaaaatgaagaagatgatgataaataagttgcttctagtgcagtttttttcttgtctataaagcatttaagctgcctgtacacaactcactccttttaaagaaaaaaacttcaacgtaagactgtgtaagatttgtttttaaaccgtacactgtgtttttttgtatagttaaccactaccgaatgtgtcttcagatagccctgtcctggtggtatttagccactaacctttgcctggtacagtatgggggttgtaaattggcatggaaatttaaagcaggttcttgttagtgcacagcacaaattagttgtatatgaggatggtagttttttcaccttcagttgtctctgatgtagcttatacaaaacatttgttgttctgttaactgaatgccactctgtaattgcaaaaaaaaaaaaacagttgcagctgttttgttgacattctgaatgcttctaagtaaatacaatttttaaaaaaccgtatgagggaactgtgtagacaaggtaccaggtcagtcttcttccatgtctattagctccacaaagccaatctcaatccctcaaaacaatcttgtcatacttgaaaatatgacactctagtcaaagccttggtaaaataatcagtgtttccaatctgtcctgttacaaaagaaacagattattattgaacttatgcaaataaccattgtcataagaatgtttatgaatagtttccaaattatggcaaattcatgtagagagagaaaagtaactgttttggttttgctcacaaaagtctactttacctaagggctgtcagatataagtaacttaaaagaaagagaagttttcttgacttttgaaaacaaaatatgaaaagaatcggcaatgtttcaaacaaaaagtcataaaagtcactttattcctccatca

SEQ ID NO: 347981 - DNA, 1990 bp, Homo sapiens
tggccaaggcccctgtcatccaggggtgcagctgacccagtcccctactctcaaggctggagtctgacttcagtaattaggtagcatctgccagctccaggtggcctttgcattgagacctagaaggggtctttaactcctacgttacagagaccaaaaagggattaggggagaatggcaaaatccatacctcgatttctgaaataaacttctaatttcttcctgccaggaactggtgaaaactcttttcgaagcctgacttggccaccttcgggttccccatctcatgctggtttgttcctgtttactactctttgagcctctgctattcttgcccctttctggaatgtgctgtggggttgcctctttgtgttaatgattgtccagaattttcaggttttacatctacagtttttccatttctgggatttaaataacaagtccttatcctctaggttgcctaggagggtttcttcctcccacaccccttaatcacacttgctgctggttcctgctgccgctgagcctggtcgttttacccatgtgcctgcttcaccattttctgcctgcatctgcttgaatctggctgttgccttggtgccttgaccttacgtccatcagtggcccgtgctgtagtggttggaggggagtgacaggcagcagagggcaaataaaatacctgtgaatcaaaccatggtttaggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttagtatagtt

SEQ ID NO: 347982 - DNA, 1718 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccaggtaagaatattagagttgcaacccgagactgtagaatatccagagtacaaatccagagctctgttttcttgattaatttcattctgagtggtctccttatgccttgattccataaattctagaatatcactttctacatttaacctctctggccctgttgagaaatggaagacattaggaaggtgttataaactcttgtttaactggattggttcaatcgattgatacattgaaaatgtagcaaaaatatgctagtaaaataacagtctttttaacaacaaactatcaagagttattatttcaagagttgaaataatgtacttattctctactactaccctttatatttgatagagcatgataagcacagtcttcctttgttcattgataattattgtcttaatcacaagctcagaaagtcttcaaagaatactttgtgctgctatttaattattaacggc

SEQ ID NO: 347983 - DNA, 1351 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataataggtaaggctgactgggagagtttgtaactgtgagtcacaggttaccaggtaaggggctcagggacttcatcacggaccatcggggcagtgcaggtagcctgggatggaggcaggaagggaaaggggctggcacctgatgcagtgagtcttcagcttgacagaagaaagtccttaggagttgggaaaataccagaagacagaaatggaggtaatcagtaagaatgtcagagaggctatttctgaagtcagagagggctgggcct

SEQ ID NO: 347984 - DNA, 687 bp, Homo sapiens
acaggtcagatgatcaaagccaaagggtggcctagtggtgggactatttctccccctcctccacaagcttctcttgttcagttttgcttttaaagaattccctgctgattcctaagactcagactaagactgttaaggaattttatttttttctgcaggtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttagtatagtt

SEQ ID NO: 347985 - DNA, 1052 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacaggtaagactgactgggttggcatgaatggggaggagccaaggggccctggctggtggcagaggaagagtctaatgcacaatacaaggagacacctgtttaacaagcaggggaaaatcacatagacacagagggggcctgttatacagatgagcctgatacactgacatactgatgacaaagacctggaggaagaaagctag

SEQ ID NO: 347986 - DNA, 602 bp, Homo sapiens
gagaggaaggcatgggagaggagttaaaaaaaaaatcagagagccaagatattcacaagaggagatggggagggaaacacatcaagacaaagagaggtataaagagacaccatcgctggaaacagaggcagaagcaggggagatggcagaacaaagaggaaagatgagaagtaaaatgagagtgaaagaaaaaaatagaatgagggttggggtaagaacagtgtcagtggatgggcacaactgccttctgtgtgtcaattttatcagcttttggttaagaacttggaacaaactgcaggtggcatgcattcaaggaacaccccagggtcttgagttaacttagcttcctgggtcttcctagtgctctcattgtggaatttcctggtgcatggactccttggtcacaccctgagactcttaatggtttttgctcctttgtgcagtcatcagcagtgaggactctgaaggatccactgacgttgatgagcccttagaagtcttcatctcagcaccgagaagtgagcctggtaaggaagtttgggagagcaaggcttgggctgtgggaatctgatttaagagctactatttcctgaggcatttta

SEQ ID NO: 347987 - DNA, 577 bp, Homo sapiens
aaatcacatagacacagagggggcctgttatacagatgagcctgatacactgacatactgatgacaaagacctggaggaagaaagctagaagcaaaaaactgagagagaaaggggaagagttgcagagtctcaccaaagaagagagacaaacaaaaggcaaaaggagaaagtaagagagagattggacaggaatcaatgaagcacgaacaccttcacgcagcaatatatgcagacaggggtataagtagaaacaggagaagaaaggagaagcagggtgaggtctaaccaaatggaaacaggacagagcaaggctctactggatctcagctgtgatctcgtttatctccagagtcctgcgaacaaattgctgtccaagtgaataatggggatgctggaagggagatgccctgcccgttgccctgtgatgaagaaagtaattattgcttaccttgcctattttctttcctttcttattcagatgctatacatttggttggttggttggttggttgttgttttaccatcgtaaccactttttaaaattaccagattaaaagctggatgtatttatcatta

SEQ ID NO: 347988 - DNA, 3643 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtgaggagcataagaagaagaacccagatgcttcagtcaagttctcagagtttttaaagaagtgctcagagacatggaagaccatttttgctaaagagaaaggaaaatttgaagatatggcaaaggcggacaaggcccattatgaaagagaaatgaaaacctatatccctcctaaaggggagaaaaaaaagaagttcaaggatcccaatgcacccaagaggcctcctttggcctttttcctgttctgctctgagtatcgcccaaaaatcaaaggagaacatcctggcctgtccattgatgatgttgtgaagaaactggcagggatgtggaataacaccgctgcagctgacaagcagttttatgaaaagaaggctgcaaagctgaaggaaaaatacaaaaaggatattgctgcatatcgagctaaaggaaagcctaattcagcaaaaaagagagttgtcaaggctgaaaaaagcaagaaaaagaaggaagaggaagaagatgaagaggatgaacaagaggaggaaaatgaagaagatgatgataaataagttgcttctagtgcagtttttttcttgtctataaagcatttaagctgcctgtacacaactcactccttttaaagaaaaaaacttcaacgtaagactgtgtaagatttgtttttaaaccgtacactgtgtttttttgtatagttaaccactaccgaatgtgtcttcagatagccctgtcctggtggtatttagccactaacctttgcctggtacagtatgggggttgtaaattggcatggaaatttaaagcaggttcttgttagtgcacagcacaaattagttgtatatgaggatggtagttttttcaccttcagttgtctctgatgtagcttatacaaaacatttgttgttctgttaactgaatgccactctgtaattgcaaaaaaaaaaaaacagttgcagctgttttgttgacattctgaatgcttctaagtaaatacaatttttaaaaaaccgtatgagggaactgtgtagacaaggtaccaggtcagtcttcttccatgtctattagctccacaaagccaatctcaatccctcaaaacaatcttgtcatacttgaaaatatgacactctagtcaaagccttggtaaaataatcagtgtttccaatctgtcctgttacaaaagaaacagattattattgaacttatgcaaataaccattgtcataagaatgtttatgaatagtttccaaattatggcaaattcatgtagagagagaaaagtaactgttttggttttgctcacaaaagtctactttacctaagggctgtcagatataagtaacttaaaagaaagagaagttttcttgacttttgaaaacaaaatatgaaaagaatcggcaatgtttcaaacaaaaagtcataaaagtcactttattcctccatca

SEQ ID NO: 347989 - DNA, 2295 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaaggtgatgatcaagtgatcttctgccaatgtctcgtctattatgttgttgattttctatctctgtggacttacagtctttaaattgacccatcatcataaaatttgattttataataaaaaacttttgc

SEQ ID NO: 347990 - DNA, 1915 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttagtatagtt

SEQ ID NO: 347991 - DNA, 2400 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtttgttcctgtttactactctttgagcctctgctattcttgcccctttctggaatgtgctgtggggttgcctctttgtgttaatgattgtccagaattttcaggttttacatctacagtttttccatttctgggatttaaataacaagtccttatcctctaggttgcctaggagggtttcttcctcccacaccccttaatcacacttgctgctggttcctgctgccgctgagcctggtcgttttacccatgtgcctgcttcaccattttctgcctgcatctgcttgaatctggctgttgccttggtgccttgaccttacgtccatcagtggcccgtgctgtagtggttggaggggagtgacaggcagcagagggcaaataaaatacctgtgaatcaaaccatggtttaggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgttagtatagtt

SEQ ID NO: 347992 - DNA, 3499 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtgaggagcataagaagaagaacccagatgcttcagtcaagttctcagagtttttaaagaagtgctcagagacatggaagaccatttttgctaaagagaaaggaaaatttgaagatatggcaaaggcggacaaggcccattatgaaagagaaatgaaaacctatatccctcctaaaggggagaaaaaaaagaagttcaaggatcccaatgcacccaagaggcctcctttggcctttttcctgttctgctctgagtatcgcccaaaaatcaaaggagaacatcctggcctgtccattgatgatgttgtgaagaaactggcagggatgtggaataacaccgctgcagctgacaagcagttttatgaaaagaaggctgcaaagctgaaggaaaaatacaaaaaggatattgctgcatatcgagctaaaggaaagcctaattcagcaaaaaagagagttgtcaaggctgaaaaaagcaagaaaaagaaggaagaggaagaagatgaagaggatgaacaagaggaggaaaatgaagaagatgatgataaataagttgcttctagtgcagtttttttcttgtctataaagcatttaagctgcctgtacacaactcactccttttaaagaaaaaaacttcaacgtaagactgtgtaagatttgtttttaaaccgtacactgtgtttttttgtatagttaaccactaccgaatgtgtcttcagatagccctgtcctggtggtatttagccactaacctttgcctggtacagtatgggggttgtaaattggcatggaaatttaaagcaggttcttgttagtgcacagcacaaattagttgtatatgaggatggtagttttttcaccttcagttgtctctgatgtagcttatacaaaacatttgttgttctgttaactgaatgccactctgtaattgcaaaaaaaaaaaaacagttgcagctgttttgttgacattctgaatgcttctaagtaaatacaatttttaaaaaaccgtatgagggaactgtgtagacaaggtaccaggtcagtcttcttccatgtctattagctccacaaagccaatctcaatccctcaaaacaatcttgtcatacttgaaaatatgacactctagtcaaagccttggtaaaataatcagtgtttccaatctgtcctgttacaaaagaaacagattattattgaacttatgcaaataaccattgtcataagaatgtttatgaatagtttccaaattatggcaaattcatgtagagagagaaaagtaactgttttggttttgctcacaaaagtctactttacctaagggctgtcagatataagtaacttaaaagaaagagaagttttcttgacttttgaaaacaaaatatgaaaagaatcggcaatgtttcaaacaaaaagtcataaaagtcactttattcctccatca

SEQ ID NO: 347993 - DNA, 1502 bp, Homo sapiens
agtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcaagcggggcactgagaagcaagcatggtgagaaggctcctatgacttctagaagtacatctacttggagaatacccagcaggaagagacttaaaaaaaaaaaagaagaagaaacaatgtcatccccagcc

SEQ ID NO: 347994 - DNA, 4641 bp, Homo sapiens
tttgagtaagcaagagctgtttattcaccaacgtgttccatttggagactgtcggcgagccctggaaagcccaggcacatttgagaaggttcctggagagggagagaatcatctttccttcccccaactccccagccccaaacacacagagagactcgggtggaagctgtctggtccaggcagtccctatttgcccgccccctcaagaagaacctcacgcaccaaaccaaccgacccctcgcggaggtggtgtaattcccccaaaatgggctctgccgcaggagaggctggctccagcgccgggggcttcggaaggagtttctgccacccccactgccgccactgaccgccccgacgccacggccggggccggggaccctgataagaaatggcccttcagccccctcccctcacctggctcggtcccacctgagggcaagagcggaggcaaaaacaaacaggcagggagggctgaccttgttgctaccgacagtggagcggcgcatcctgctgcttcctggaaagcggcccgaaagacattttttccccctggaggaaggaaacgggagggcgccggccagacggcggcaggcgcggaggcgttggtccgggcgggctgtgcagcctctagtggagacggtccgaagactacatctcccaggctgctctgggccgccctgcgtcgtaaccctggcgcgcacggaggcggcgactcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgtt

SEQ ID NO: 347995 - DNA, 4748 bp, Homo sapiens
tttgagtaagcaagagctgtttattcaccaacgtgttccatttggagactgtcggcgagccctggaaagcccaggcacatttgagaaggttcctggagagggagagaatcatctttccttcccccaactccccagccccaaacacacagagagactcgggtggaagctgtctggtccaggcagtccctatttgcccgccccctcaagaagaacctcacgcaccaaaccaaccgacccctcgcggaggtggtgtaattcccccaaaatgggctctgccgcaggagaggctggctccagcgccgggggcttcggaaggagtttctgccacccccactgccgccactgaccgccccgacgccacggccggggccggggaccctgataagaaatggcccttcagccccctcccctcacctggctcggtcccacctgagggcaagagcggaggcaaaaacaaacaggcagggagggctgaccttgttgctaccgacagtggagcggcgcatcctgctgcttcctggaaagcggcccgaaagacattttttccccctggaggaaggaaacgggagggcgccggccagacggcggcaggcgcggaggcgttggtccgggcgggctgtgcagcctctagtggagacggtccgaagactacatctcccaggctgctctgggccgccctgcgtcgtaaccctggcgcgcacggaggcggcgactcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattta

SEQ ID NO: 347996 - DNA, 4698 bp, Homo sapiens
tttgagtaagcaagagctgtttattcaccaacgtgttccatttggagactgtcggcgagccctggaaagcccaggcacatttgagaaggttcctggagagggagagaatcatctttccttcccccaactccccagccccaaacacacagagagactcgggtggaagctgtctggtccaggcagtccctatttgcccgccccctcaagaagaacctcacgcaccaaaccaaccgacccctcgcggaggtggtgtaattcccccaaaatgggctctgccgcaggagaggctggctccagcgccgggggcttcggaaggagtttctgccacccccactgccgccactgaccgccccgacgccacggccggggccggggaccctgataagaaatggcccttcagccccctcccctcacctggctcggtcccacctgagggcaagagcggaggcaaaaacaaacaggcagggagggctgaccttgttgctaccgacagtggagcggcgcatcctgctgcttcctggaaagcggcccgaaagacattttttccccctggaggaaggaaacgggagggcgccggccagacggcggcaggcgcggaggcgttggtccgggcgggctgtgcagcctctagtggagacggtccgaagactacatctcccaggctgctctgggccgccctgcgtcgtaaccctggcgcgcacggaggcggcgactcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattta

SEQ ID NO: 347997 - DNA, 4826 bp, Homo sapiens
tttgagtaagcaagagctgtttattcaccaacgtgttccatttggagactgtcggcgagccctggaaagcccaggcacatttgagaaggttcctggagagggagagaatcatctttccttcccccaactccccagccccaaacacacagagagactcgggtggaagctgtctggtccaggcagtccctatttgcccgccccctcaagaagaacctcacgcaccaaaccaaccgacccctcgcggaggtggtgtaattcccccaaaatgggctctgccgcaggagaggctggctccagcgccgggggcttcggaaggagtttctgccacccccactgccgccactgaccgccccgacgccacggccggggccggggaccctgataagaaatggcccttcagccccctcccctcacctggctcggtcccacctgagggcaagagcggaggcaaaaacaaacaggcagggagggctgaccttgttgctaccgacagtggagcggcgcatcctgctgcttcctggaaagcggcccgaaagacattttttccccctggaggaaggaaacgggagggcgccggccagacggcggcaggcgcggaggcgttggtccgggcgggctgtgcagcctctagtggagacggtccgaagactacatctcccaggctgctctgggccgccctgcgtcgtaaccctggcgcgcacggaggcggcgactcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacaggtacgggcagctgtgggggggaccgggagccgccgaccctcgctctggccctgcccgcgcccgccctcgaggctcttgaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattta

SEQ ID NO: 347998 - DNA, 4617 bp, Homo sapiens
tttgagtaagcaagagctgtttattcaccaacgtgttccatttggagactgtcggcgagccctggaaagcccaggcacatttgagaaggttcctggagagggagagaatcatctttccttcccccaactccccagccccaaacacacagagagactcgggtggaagctgtctggtccaggcagtccctatttgcccgccccctcaagaagaacctcacgcaccaaaccaaccgacccctcgcggaggtggtgtaattcccccaaaatgggctctgccgcaggagaggctggctccagcgccgggggcttcggaaggagtttctgccacccccactgccgccactgaccgccccgacgccacggccggggccggggaccctgataagaaatggcccttcagccccctcccctcacctggctcggtcccacctgagggcaagagcggaggcaaaaacaaacaggcagggagggctgaccttgttgctaccgacagtggagcggcgcatcctgctgcttcctggaaagcggcccgaaagacattttttccccctggaggaaggaaacgggagggcgccggccagacggcggcaggcgcggaggcgttggtccgggcgggctgtgcagcctctagtggagacggtccgaagactacatctcccaggctgctctgggccgccctgcgtcgtaaccctggcgcgcacggaggcggcgactcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattta

SEQ ID NO: 347999 - DNA, 3126 bp, Homo sapiens
aaaaagaaaactgtttcatttgcagtcatctgaattagtttagcatcaaagcctatgtcttttgtgatctaaataaaattatttttattactctgtttctctaaatctgcattataaaaagctaattttcctttttattttagggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattta

SEQ ID NO: 348000 - DNA, 3050 bp, Homo sapiens
gtacccagggaacgtgccagcactgcgttgttcctcaagtcccacatgtccctaggctgtctgccttggttctccctttcaaagcttgcctgtgcttatttgttgtattttgtccagagtgtttcaagtggaggggggaagacctgggaagaatggggcctaacccatcttggcagaacaccgtcgaagcttcgacggtgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattta

SEQ ID NO: 348001 - DNA, 2888 bp, Homo sapiens
cctgttatgttttcattaccaagacgcagagtatctagcctcggcttttgctgattcgcagagttgaggtacgagggtgaatgcccccaaggtaattcttcctaagactctggggctacctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattta

SEQ ID NO: 348002 - DNA, 2482 bp, Homo sapiens
tttgagtaagcaagagctgtttattcaccaacgtgttccatttggagactgtcggcgagccctggaaagcccaggcacatttgagaaggttcctggagagggagagaatcatctttccttcccccaactccccagccccaaacacacagagagactcgggtggaagctgtctggtccaggcagtccctatttgcccgccccctcaagaagaacctcacgcaccaaaccaaccgacccctcgcggaggtggtgtaattcccccaaaatgggctctgccgcaggagaggctggctccagcgccgggggcttcggaaggagtttctgccacccccactgccgccactgaccgccccgacgccacggccggggccggggaccctgataagaaatggcccttcagccccctcccctcacctggctcggtcccacctgagggcaagagcggaggcaaaaacaaacaggcagggagggctgaccttgttgctaccgacagtggagcggcgcatcctgctgcttcctggaaagcggcccgaaagacattttttccccctggaggaaggaaacgggagggcgccggccagacggcggcaggcgcggaggcgttggtccgggcgggctgtgcagcctctagtggagacggtccgaagactacatctcccaggctgctctgggccgccctgcgtcgtaaccctggcgcgcacggaggcggcgactcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttggtaagacggctttaacattacttatattaccttgcaaaagagaatgaagtgtatttgtttttaaaaggtggggaactgtataaatattcggtctgtggctcctatgcattaagcctctatttgagcctcactatcattcaatagcttgagtggaaataaaaagaggagaaaccactgcagcagttctggccttttggaactatgttgtaggtgctttctctcctggcatatgcatgaatcatcacacctgtccctcttgccagtgggattacagtactttactatcagaccacctggttcaaatcccatcacagaaattgtcttgctgtgaaatctaaatcaaatgtctggactttttgttcctgtagtatggtgatggtaataatcaggattattgtgaggattgtataagtactagcacatagtaagcactcatgttgtttgctattattgttactcccacttctcccctctggtggcatgtaacctgcacggaccttggaggactgaacaaagggggcaagcgtgggaataaaagacaaagacaagagagtatatttggaagaaggggtcagggggcaccttgcctctagtggacaagggccctgagctttacacagccctctgtatttattaggcaaaagagatagtgagaagcaggggtgattgtcgggtaattgtcagtccatttggcagtttggttcacagcaggcttgc

SEQ ID NO: 348003 - DNA, 4267 bp, Homo sapiens
  misc_feature (17)..(17): n is a, c, g, or t
tgcaggctgtacccccnggggttatgggatatcgtcgacccacggcgctcgcatcctgagggcaagagcggaggcaaaaacaaacaggcagggagggctgaccttgttgctaccgacagtggagcggcgcatcctgctgcttcctggaaagcggcccgaaagacattttttccccctggaggaaggaaacgggagggcgccggccagacggcggcaggcgcggaggcgttggtccgggcgggctgtgcagcctctagtggagacggtccgaagactacatctcccaggctgctctgggccgccctgcgtcgtaaccctggcgcgcacggaggcggcgactcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgtt

SEQ ID NO: 348004 - DNA, 4732 bp, Homo sapiens
tttgagtaagcaagagctgtttattcaccaacgtgttccatttggagactgtcggcgagccctggaaagcccaggcacatttgagaaggttcctggagagggagagaatcatctttccttcccccaactccccagccccaaacacacagagagactcgggtggaagctgtctggtccaggcagtccctatttgcccgccccctcaagaagaacctcacgcaccaaaccaaccgacccctcgcggaggtggtgtaattcccccaaaatgggctctgccgcaggagaggctggctccagcgccgggggcttcggaaggagtttctgccacccccactgccgccactgaccgccccgacgccacggccggggccggggaccctgataagaaatggcccttcagccccctcccctcacctggctcggtcccacctgagggcaagagcggaggcaaaaacaaacaggcagggagggctgaccttgttgctaccgacagtggagcggcgcatcctgctgcttcctggaaagcggcccgaaagacattttttccccctggaggaaggaaacgggagggcgccggccagacggcggcaggcgcggaggcgttggtccgggcgggctgtgcagcctctagtggagacggtccgaagactacatctcccaggctgctctgggccgccctgcgtcgtaaccctggcgcgcacggaggcggcgactcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattta

SEQ ID NO: 348005 - DNA, 2404 bp, Homo sapiens
tttgagtaagcaagagctgtttattcaccaacgtgttccatttggagactgtcggcgagccctggaaagcccaggcacatttgagaaggttcctggagagggagagaatcatctttccttcccccaactccccagccccaaacacacagagagactcgggtggaagctgtctggtccaggcagtccctatttgcccgccccctcaagaagaacctcacgcaccaaaccaaccgacccctcgcggaggtggtgtaattcccccaaaatgggctctgccgcaggagaggctggctccagcgccgggggcttcggaaggagtttctgccacccccactgccgccactgaccgccccgacgccacggccggggccggggaccctgataagaaatggcccttcagccccctcccctcacctggctcggtcccacctgagggcaagagcggaggcaaaaacaaacaggcagggagggctgaccttgttgctaccgacagtggagcggcgcatcctgctgcttcctggaaagcggcccgaaagacattttttccccctggaggaaggaaacgggagggcgccggccagacggcggcaggcgcggaggcgttggtccgggcgggctgtgcagcctctagtggagacggtccgaagactacatctcccaggctgctctgggccgccctgcgtcgtaaccctggcgcgcacggaggcggcgactcttacctcacaaaggtagctcctccgccggcagcaactcggcgcccgcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaatcacttcactccagcctgggcgacagagcgaaactctgtctca

SEQ ID NO: 348006 - DNA, 3584 bp, Homo sapiens
ccccctgggagttttcagtctaagatgatgctgacatggacagacataaaggatattgagacaactgaacaaacattgaacaagaacataaagtactaacattatgcacaagcaaaggggtccagtggtttacgtcttggatcttgcagatagactgatctcaaaagcctgtccatttgctgcagcaggaataatggtcggctctatctattggacagctgtgacttatggagcagtgacagtgatgcaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttgggtggaattgcgtttgttgccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcacctcctatttcccaggcactgtgcagagtgctgtaggacatagtggtgaacaagacagacttggtccaagctcttacagagttgacagtctagtttcagcacatagaaaaccagcagtgaataaaccaaggtgaggccttgagctctttgtttttatattaatgaggagaaaagtatgaaaacaagaagtcttaagtaaatattgaggtcattgtttttggcttaagtttattatagaaaatcaacactaatgtttttagattttaattgtcctattgatgaggctagcaccttaatcactgtttagttttgtattcatttttaaaagcaattattgaagccattttcaatagattggccattttaatgttcagcaacctgaatggttatttttgttaattaaaattaaatttttaagagatattttcaaaaccctatttattttcttgttcacagtaatgcatgtcaataataaatgtttccccttactgataagcggccactttaggagtgtagcaaatatagattgagctatgttagtttgcaataatatatgttaactttagtaattaaagactggtttctatagtatgaatgtcttaattttgagttatatgatgtttatttgaatgactgttgaacattcaaatttgtattatttggagatgaagatttgactaacagtgagccttattaagaacactactacagttctgaaggggaaatataacatctatggttatatattttaaaaacttagattataggctgtaattataaaatatattggcttttgttttcaatgtgaaagatacattaaatggacacatatcttgcaaaattttgttgtatagaacagtttttaggcagcctttactaaagttatgcaaacacacagttccccatttactacattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattctattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaattta

SEQ ID NO: 348007 - DNA, 1104 bp, Homo sapiens
gcgactctagaggatccccagcggggaacaatcacttcttgctgtcctctgtgctgtgctgaggaatccaacctctctcttaagtgacgagtgcaagagagaaataggattatttgtgttttggaaaaaaaccttagttcattgtagagggcggacagcaagaagtgatgaggacctttaagaccacggtagtggaatttgagaggcaagagcagatttgagaactattaagaagacagactcatcagccctgtatacatgattgtgtaatggaacagaggaatgagggacctatgtaagataacgtggagttctggggtgggtggctaggtggctcatggtaccattcaccaagatgggaagtgcagaacaggcttggttagaaagaaaatgagttcagttttgcacttacttaatcctggcagacaagcaggtataaaatgggttgagctggaagacaggtcttggctatagcttagggagattttatcatattgcttatagctcaagcaatgggtatggatgaggtaacacaggcacgatgtaaaaatgagaaaataaaaataaaataataaaagtgattgcggcccaccaacacttggagagtggaagtagaggagattgagaaggagtggccacagatggaggtattgaaagggaaacaatagtcttgtagaaatccaaagaagagtttcaggaaagtcagaaaggttaagactgcccagtgctttagagtgagtggccttaattccataacagtgcaacagccatttcagaaaataggtagaggaggtttaggagtgttggagggagagaaagttgagactcttcccaggagcctaggactgaagagtaagtaagggaaggtattacctcacagtggacattgggtgtattgaagggggaatttgggtatgtgtgtgggagcatgagagagagacagagacattttcagatggagagacttgagtgcatctgctaaggagaagacatcagtggaggaggaagcatcagaaacatatttgagaggagatgatcggtggagctaagtctcagaggacacaatgggttagaagtgtttagccttggaaggagggcagcacc

SEQ ID NO: 348008 - DNA, 667 bp, Homo sapiens
cccttgagccatgttgcctaattgtccccaagcagaaaacttcccaggtcttcggaggcagcaaaagctttcctggcacagagctagaaaagaagattctcatggtgtcccatgtggcaggaactacaggagctggggtgggtaatccatttaggccacttgacaaacacctatttgtaggtcaactctgagaatagaaagatgaaaaaggagtggcctctgccatcctggagctaagcaactggtataagggaagtgacagcccccatggaatcggaccatttcaacttcatgccacgaatgacaggtcagggcttctgggcatgatcataggaatgaccacagctaacattgaccatgggcctaatttgtgtgctgtttgctttttttttttttgagacggagtctcactcaagtcgccaggctggatggagtgcagtggtgcgatctcggctcactgcagcctccgcctcccaggttcaagcaattctcctgcctcccaggttcaagcaattctcctgcctcagcctcccgagtagctgggattacaggtgccctccaccacgcctggctaatttttgtatttttagtagagacggggtttcaccatgttggccaggatggtctcaatctcttgacctcgtgatccgcccacctcgccctccca

SEQ ID NO: 348009 - DNA, 2094 bp, Homo sapiens
agagcggagtctgcgcggggttgggcggagcctgcgcggggccggtaggatcgcgtcgggagccggtaccgaggcccgagccgcgggagtcgagcgaagacagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaatagaccaaaagtgaagttaagaaggtggaagggagaaggaagacattttacaaaaaggatactcttctactaaaagataaccccgcacggcatttcacacttgcctacgtcaccctgctttccacgcacctcctcagagggaggggctgttattgttcctgttttatgaaaaaagccgagagaggctacagaacctgtttgatgtgatagctaattatggtccgcggagcctcaaaccgagtcgggcctgtgactccgagctgcgctgcctcgtattgattgtcatgcctttctccaaatacgcaccagataaactattgtatctattcagtatgactgttctaactctggctttgagctgtcgaggtggcttctaccttaggtctagtttttggaaaggtgaagcaggagtggaagctctctaagggatacgaaatctgattttatccaaagaaatcacagcagcctttgaaagacacattcagattttcaaacaaacaacagacatttcaaaaccaggcgctctgcttattcactgaaaccgtaagctgctgaaactcagggaaaagcttaagaaactggtcttaaagcttcaggccaaacaatgcttcaaatcacatttgaagtaatcacttaaaaacagtagaaaaatcagttatcaattacctaaaacacttatacccaataaaatattcccatgatgaaaa

SEQ ID NO: 348010 - DNA, 361 bp, Homo sapiens
ataggccaatgcagtggactaactggtttcccagaccaggcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatattaaacgtttaaa

SEQ ID NO: 348011 - DNA, 2538 bp, Homo sapiens
agagcggagtctgcgcggggttgggcggagcctgcgcggggccggtaggatcgcgtcgggagccggtaccgaggcccgagccgcgggagtcgagcgaagacagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatattaaacgtttaaa

SEQ ID NO: 348012 - DNA, 2561 bp, Homo sapiens
agagcggagtctgcgcggggttgggcggagcctgcgcggggccggtaggatcgcgtcgggagccggtaccgaggcccgagccgcgggagtcgagcgaagacagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaagtaagtataaccttttcaccaaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatattaaacgtttaaa

SEQ ID NO: 348013 - DNA, 1797 bp, Homo sapiens
agagcggagtctgcgcggggttgggcggagcctgcgcggggccggtaggatcgcgtcgggagccggtaccgaggcccgagccgcgggagtcgagcgaagacagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgcca

SEQ ID NO: 348014 - DNA, 1895 bp, Homo sapiens
cccatgttggccaggctcgtcttgaacttctgatctaatcatccacccgccttggcctcccaaagtgttgggattacaggcatgagccaccatgcctggtgggatccagattccttcttttgcttgggggcatcctgttgtcccagcatcatttgttgaaaaggcactagtatttttccttaaactttttatttatttagaacacagactgcagagtagtatgatggatctccagctccagttgtcaccatcttgctgttcttgtttcacctatcactgcctctaatcttttttgagtattttaaatcccatttttcagttttccaggtgattctaatgtgcagccaaaggttgaattactgaaatggatcctcaaaatcttatgacataaatttgttcatacctactcttcattccacaagagggaacgaaaggttactcattaaaaaatcttaaacattttaatatttaaatctgtccaggaatctcatgtcctgtaagattacatattgtctttcttggctgttgactggttcctggaaattagggtcagagtctttgcctggatcagagctcctgttcccatgccgtgccctgcacacccctccacactgcagcctgttccctctggagttcagggaggctttagacccagctatggctgctgcgcctcgacctgtcttcgtctctagctgccgtgctgttcctggtctctgctgccgcctaacttggggttctgtctcctaggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgccactttccagtatttttgagcttatttaatgagttctggaacatttatatctaatctatattttagataattactttttatacttttttaactcatggtatccccactccccacccccacctcatttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaactgattcagttgtgttggaaaaaataaagaaatctgatattaaacgtttaaa

SEQ ID NO: 348015 - DNA, 404 bp, Homo sapiens
tacgttgtatgttttcttcaagaatagtctcttgagaaaacttcggatttatgctataaaaacatagatttgcctcaatgatctaaatatttgtagaacctgctcacatggctatatcataaagcaaacattggcgaattcttttgacccatattttctgctgtatactggactttcacggttagttgtttgagctttgggacagctttggacgatgagtccacaggtcgtgtctgtcttgattttacaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatata

SEQ ID NO: 348016 - DNA, 414 bp, Homo sapiens
atttttatttgtcccttctcaaagcagccacttagcccacatgggcgaaatcaagtctccagttatttctgccacaactgcttctaaggcctcctccttctcctcctcctcttcctcttcctccttttccttctcctcctcctctcttcccagtgacagcatcatcgtgctgtttgcctgtattggctatgccttctaactccaaccagtcacttgagaatattctttcaagattctgggccccgattcttttctgtttaaatccctaaagcaaagatctaattctcaagcaatgtctgtagttcagtgggggtgaacaatgaatatattcatgctaggaatttgtgtctgttgttgtactcacagcagcaacatgagtgtaaacagtagacaataaacttttatttaagaaaa

SEQ ID NO: 348017 - DNA, 1951 bp, Homo sapiens
agagcggagtctgcgcggggttgggcggagcctgcgcggggccggtaggatcgcgtcgggagccggtaccgaggcccgagccgcgggagtcgagcgaagacagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgcca

SEQ ID NO: 348018 - DNA, 702 bp, Homo sapiens
agagcggagtctgcgcggggttgggcggagcctgcgcggggccggtaggatcgcgtcgggagccggtaccgaggcccgagccgcgggagtcgagcgaagacagcgccgaggccgcggtttccccctgggcctccccagcagcagccatgggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcaggatcaacacagcccttagacttatcctttgatggcagtgtacatttccatcttgctattataccagaattcatctgactttttacttccttgga

SEQ ID NO: 348019 - DNA, 1923 bp, Homo sapiens
  misc_feature (21)..(21): n is a, c, g, or t
  misc_feature (23)..(23): n is a, c, g, or t
  misc_feature (38)..(38): n is a, c, g, or t
  misc_feature (49)..(50): n is a, c, g, or t
gagcatctatcgctatacacntnattggaacaccgttntggtgttaaannaaagcagtgtaccgtccgatccggatgcagacaggcgagcgcgttccccctggggctcccagcagcagcatggcatcaaatttttagaagttatcaaaccattctgtgcagttctaccagaaattcagaaaccggaaaggaaaatccagtttagagagaaggttctgtggactgctataacgctcttcattttcttagtgtgttgtcagatcccactgtttggaatcatgtcatcagattctgcagatcctttctactggatgagagttattctggcttccaatagaggaactttaatggaattgggtatctccccaattgtaacatctggtttgattatgcagttgttagctggagccaaaatcattgaagttggagatacaccgaaagatagagctttattcaatggagcccagaaactgtttggtatgatcattaccattgggcaagccattgtgtatgtcatgacggggatgtatggggaccctgcagaaatgggtgccggaatctgtctcctgatcatcattcagttgtttgttgctggtttgattgtgctgctgttagatgagctgctacagaagggttacggcttggggtctgggatttccctctttattgccaccaacatctgtgagaccattgtctggaaggcctttagtcccactaccattaacactggcagaggtactgagtttgagggtgcagtcatagctctgttccatttgttggccaccaggacggacaaagtccgagctttacgggaggctttttatcggcagaacttacccaatctcatgaacctcattgctacagtttttgtgtttgctgttgttatatatttccaaggatttcgcgttgatctgcccattaagtcggcccgttaccgaggacagtacagcagctaccccatcaaactcttctacacctccaacatccccatcatcctccagtcggccctggtgtccaacctgtatgttatttcccagatgctgtctgttcgatttagtggcaactttttagtaaatttactaggacagtgggccgatgtcagtgggggaggacccgcacgttcttacccagttggaggcctttgttactatctttctcctcctgagtccatgggcgccatctttgaggatcctgtccatgtcgttgtttatatcatcttcatgttggggtcatgtgcattcttctctaagacatggattgaagtgtctggttcctcagccaaagatgtagctaaacagctgaaagaacagcagatggtaatgaggggccaccgagatacctctatggttcatgagcttaataggtacatccccaccgcagctgcgtttggcggtttgtgcattggcgccctgtcagtgctggctgacttcctgggggccattggatctggcactggaattctgctagcagtcactattatttaccagtattttgaaatatttgttaaagaacaggccgaagttggtgggatgggtgctttgtttttctaaatgttcaaatatttcattttgtgcgtgtgaaagggaaaacactttgacggatcgtttttgtcagatgacactggtggctccccttttctcccctcacagtttcttgtttcgagtgctgactgacccgtttctgaaatgggcaccgagctaagtctgtgtgcagcattagtacccgctgccttaaaactcaagtttacattattcattaaaaaaagtacatctagtgttgcctgtaatgctggaaaccagtgtatctaccttgctgtgttaaatcatgacagtgagacggtgagatggattcgttttgcacacaacattcaaaacacttcatattgcccccacttgttgaaaaataaatgtagttcaaattgcca

SEQ ID NO: 348020 - DNA, 324 bp, Homo sapiens
ctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccat

SEQ ID NO: 348021 - DNA, 229 bp, Homo sapiens
cggaatacaccagcgcggaatacaccagcgcggaatacaccagcgcggaatacacgcgcggaatacaccagcccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccat

SEQ ID NO: 348022 - DNA, 317 bp, Homo sapiens
tcagttgtcatctttttactgagtgtccttcctgacctctccctactttaaaatgttatgcttttttctactacctctcctgttcctcattcctaccttatttttctggataacacttattgccttctaaattgtatcgtataatttacttctttgtttcttctccgttgtcacactagcatataaattcagtgaaggtagagattcttttactgctgacaaaagcatctaggacatttcctggcactgataaggatctgcataaatatttgttgagtgaatgaatctccttggtaaagtccttttttgtttgcctg

SEQ ID NO: 348023 - DNA, 1122 bp, Homo sapiens
taatttgacagccatgcattttttactggttggttctctttagtttacatttttaaaaataactcatgccccattcacccagagctcaaagtggtctgcaggagaagccagtacaaagaatcaggatggcatttcttgaagtgggtaaggatcgttatattgcatgtcagtacaaatcccagtaaagattttaagctggttagaccttgctgagaggtaatggggagggtctacaattttgtattcacctttccccaagtggggccctgtttccagctttcttcttttacctgaacttgcttctttggctacagggagaacttcgggtgaaatgcatccctcctgtgactggattggagacacaagaacagaaacatcctgatctctctactctactgtgcaggcttatgtactcataaaatggcagttatggacctatcctccccatgggctttaactaaacaggactctgcctgtttccatctgagaaatgctgaagaggaaaggatgattgctgtatttctgacaacctggttacaggaaccaatgactttcaaagatgtagctgtggagttcactcaggaggagtggatgatgctggattctgctcaaagaagtctgtacagagatgtgatgttggaaaactatagaaatctcacctccgtggaatatcagttgtacaggcttactgtgatctccccattggatcaagaagagataaggaatatgaaaaagagaattccccaagccatctgtccagaccagaagattcaacctaaaaccaaagaatcaactgtgcagaaaattttgtgggaggaaccatccaatgcagtgaaaatgataaaactcacaatgcataattggtcctccacattaagagaagactgggaatgccataagatcagaaaacagcataagattccagggggacattggaggcaaatgatatatgccccaaagaaaacagtacctcaggagctattccgtgactatcatgaattagaggaaaactctaaacttggatcaaaacttattttttcacagagcattttcaccagtaaacattgccaaaaatgttactcagagattggatgtttgaaacacaattcaatcataaacaat

SEQ ID NO: 348024 - DNA, 252 bp, Homo sapiens
agcatacatatcaacgcaacagaacagaaattccagaaacttctcataacaatttagcatgtaaatagcatttcaaattaatggaaagaatattcaattaattgttctgagaaaattggctaaatttctgaaaaaaattgagttgagatcttagctcacacacaaaaaaaggttcaaatatctgaaaatgttaaaggcaaaaaataaaccatatttatgtccagccagggcaagacagcgagatcctatttc

SEQ ID NO: 348025 - DNA, 372 bp, Homo sapiens
atcctcagaactagtacttttttcttgataggaagaataatttgttttgtcaatgattaaaaattatcctagaacgcagtcactgccaaggatgtggtttactcatatccgtagtttgggaacaaaattatgtttcaaactgtaaggttggacatgctggctcctgcttgtaatctcagaactttgggaagccaaggcaggaggatcgctttaaggccaggagtttgagaccagcctggggaacataacaaaacctagtcttcaaaaaaaaaaaaaaaaaaaaaaaaaaagccaggagtggtggcacacacctataggcctagctattcaggaagctgagacagaaggatctcttgagcccaggagtttgag

SEQ ID NO: 348026 - DNA, 272 bp, Homo sapiens
ggcaacaagaatgaaactctgcctcaaaaacaaaacaaaacaaaacaagaaacaaaacacacacacacacacacacaaacctgtgcttagaacagtgtacagaaccaaaaacaatttatttcttttagaataatgaacttaatcttcacagcaatcttaggccatagatgctatactaggggatagatactatccccattctatggaagaggaaattgaggctttgagtggtcaagtaatttaccaaatattactcagcttaccaatggcca

SEQ ID NO: 348027 - DNA, 618 bp, Homo sapiens
ctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccggtaagaagagaccaatgtctgagatggggaacagcagatttgaagaaatttgcaacatttaaattctctgtaaatagactggtgatgctgtgcaacgtggaacacggtcaagtttcctttaaaaattcttcactctaccatattggttataaagaatcttagcttctttccttcatattcagaacatctcactaaacatggaaaatttgttaacacaaacttttaaatga

SEQ ID NO: 348028 - DNA, 2164 bp, Homo sapiens
tcctgtgatctgctctccttcagggtggccaaggagggggcagttgcttgaagttcaccactaagctcaaagaggaaaacatgcaaatggtggcttctcctccatgtcagatgtgatctctctcttctttcctgctaccgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccgttggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaaaaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaa

SEQ ID NO: 348029 - DNA, 2226 bp, Homo sapiens
ctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccgttggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgaggtaagtgctttattaggatctcttaaattatttccttgaatctacttgcccatttagctggccattcagccaccaaagactgatagctgcacacattcttttttttcctttttttttttttttaatttgagacaaggtctcgctctttcacccaggttggagtacagtgg

SEQ ID NO: 348030 - DNA, 1014 bp, Homo sapiens
gatcttatttcacttcatccttcttgtaaccatattgtcaatcaggaaagctcaatcagatacaaaaacaggaaattcgttaaaagtaacgtttgtagaagatactagttgaggaggagagacttttgagaaagcctgtgtgtgtttgtgacactcttgtgaccgtgccaagaaaacgtaagcaaatatcaagcctccaaatcctaatgcaacaagtcctgaatcccttggtatgtcctggatgatgaatacacaagctcagtaggctccaaatttccagtccgttggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaaaaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaa

SEQ ID NO: 348031 - DNA, 956 bp, Homo sapiens
gatcttatttcacttcatccttcttgtaaccatattgtcaatcaggaaagctcaatcagatacaaaaacaggaaattcgttaaaagtaacgtttgtagaagatactagttgaggaggagagacttttgagaaagcctgtgtgtgtttgtgacactcttgtgaccgtgccaaggtatgtcctggatgatgaatacacaagctcagtaggctccaaatttccagtccgttggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaaaaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaa

SEQ ID NO: 348032 - DNA, 540 bp, Homo sapiens
gaggacctaagagtatgaaaaattctaagagcttttaaacgctacattcctagatatgaagagttcaggaatccttcagatagttcacataacctgaacaccattgctgactgaagattctgcctttctttgttttctacaataaatatacaaattgtcccctaagattagtactttcaaggtctttctccttttttctgaatcctaactgctgaagtctgtgttttcatcgacccaggttgtatatgatgaagggcctctctacgtcttctccccaactgaagaactaaggaagcggtggattcaccagctcaaaaacggtgagaattatttggaaaataaatgtttccaaagaaagaaggaaaggaaggaagaggagatagacgggaggaaaaggaaagaaggaagagagaaacgagaaagaaagagaaaggagaaacgtagagagaaaagaagaaaaaaatggatagaaggggagaaaagaaagagagagggaggggaggagggagacaggaaggaaggaagcaaggaaagaaggaa

SEQ ID NO: 348033 - DNA, 491 bp, Homo sapiens
aatccttggggagtgcttactgtgtgtcagccaccacaggggtttctgaggatgaaaactaaactggacatgatctctgcctttttagaacttaaaccatgttaaggaaaacaattcattcagttttcaacagcttctgaatactgattatgtaccaggcactctgccagaccctataactgcaaagacaaataagatgctgtctctcttctagaggagttaatagtctagtacgaccttgatctccatctagtgtggtcagtactatagcagaaatttgggcaaaatataaaaagcacagagcggggaaccaactgattctaatctttgaggttgatctaggaagactaggacccctgctatccaaaaagactgcaaaccaatttaataatttttttcaccttctaggggttttgatgtgggaaatttactccctggggaagatgccatatgagagatttactaacagtgagactgctgaacacattgcc

SEQ ID NO: 348034 - DNA, 2563 bp, Homo sapiens
ctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggcagctcgaaactgtttggtaaacgatcaaggagttgttaaagtatctgatttcggcctgtccaggtatgtcctggatgatgaatacacaagctcagtaggctccaaatttccagtccgttggtccccaccggaagtcctgatgtatagcaagttcagcagcaaatctgacatttgggcttttggggttttgatgtgggaaatttactccctggggaagatgccatatgagagatttactaacagtgagactgctgaacacattgcccaaggcctacgtctctacaggcctcatctggcttcagagaaggtatataccatcatgtacagttgctggcatgagaaagcagatgagcgtcccactttcaaaattcttctgagcaatattctagatgtcatggatgaagaatcctgagctcgccaataagcttcttggttctacttctcttctccacaagccccaatttcactttctcagaggaaatcccaagcttaggagccctggagcctttgtgctcccactcaatacaaaaaggcccctctctacatctgggaatgcacctcttctttgattccctgggatagtggcttctgagcaaaggccaaaaaattattgtgcctgaaatttcccgagagaattaagacagactgaatttgcgatgaaaatattttttaggagggaggatgtaaatagccgcacaaaggggtccaacagctctttgagtaggcatttggtagagcttgggggtgtgtgtgtgggggtggaccgaatttggcaagaatgaaatggtgtcataaagatgggaggggagggtgttttgataaaataaaattactagaaagcttgaaa

SEQ ID NO: 348035 - DNA, 585 bp, Homo sapiens
ttcgtcactttatctcttttggtggactctgctacgtagtggcgttcagtgaagggagcagtgtttttcccagatcctctggcctccccgtccccgagggaagccaggactagggtcgaatgaaggggtcctccacctccacgttccattcctgttccacctcaaggtcactgggaacacctttcgcagcaaactgctaattcaatgaagacctggagggagccaattgttccagttcatctatcacatggccagttggtccattcaacaaatggttattggatgcccattatgtggcaggcactgttccgggggagagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggaaaagaggcaataaaaagggttcatagatgttgaaaaaatcattgtgtagtaacagcgaaagctggaatttactccataaagctatcgtttggat

SEQ ID NO: 348036 - DNA, 2177 bp, Homo sapiens
ctctctggactgtaagaatatgtctccagggccagtgtctgctgcgatcgagtcccaccttccaagtcctggcatctcaatgcatctgggaagctacctgcattaagtcaggactgagcacacaggtgaactccagaaagaagaagctatggccgcagtgattctggagagcatctttctgaagcgatcccaacagaaaaagaaaacatcacctctaaacttcaagaagcgcctgtttctcttgaccgtgcacaaactctcctactatgagtatgactttgaacgtgggagaagaggcagtaagaagggttcaatagatgttgagaagatcacttgtgttgaaacagtggttcctgaaaaaaatcctcctccagaaagacagattccgagaagaggtgaagagtccagtgaaatggagcaaatttcaatcattgaaaggttcccttatcccttccaggttgtatatgatgaagggcctctctacgtcttctccccaactgaagaactaaggaagcggtggattcaccagctcaaaaacgtaatccggtacaacagtgatctggttcagaaatatcacccttgcttctggatcgatgggcagtatctctgctgctctcagacagccaaaaatgctatgggctgccaaattttggagaacaggaatggaagcttaaaacctgggagttctcaccggaagacaaaaaagcctcttcccccaacgcctgaggaggaccagatcttgaaaaagccactaccgcctgagccagcagcagcaccagtctccacaagtgagctgaaaaaggttgtggccctttatgattacatgccaatgaatgcaaatgatctacagctgcggaagggtgatgaatattttatcttggaggaaagcaacttaccatggtggagagcacgagataaaaatgggcaggaaggctacattcctagtaactatgtcactgaagcagaagactccatagaaatgtatgagtggtattccaaacacatgactcggagtcaggctgagcaactgctaaagcaagaggggaaagaaggaggtttcattgtcagagactccagcaaagctggcaaatatacagtgtctgtgtttgctaaatccacaggggaccctcaaggggtgatacgtcattatgttgtgtgttccacacctcagagccagtattacctggctgagaagcaccttttcagcaccatccctgagctcattaactaccatcagcacaactctgcaggactcatatccaggctcaaatatccagtgtctcaacaaaacaagaatgcaccttccactgcaggcctgggatacggatcatgggaaattgatccaaaggacctgaccttcttgaaggagctggggactggacaatttggggtagtgaagtatgggaaatggagaggccagtacgacgtggccatcaagatgatcaaagaaggctccatgtctgaagatgaattcattgaagaagccaaagtcatgatgaatctttcccatgagaagctggtgcagttgtatggcgtctgcaccaagcagcgccccatcttcatcatcactgagtacatggccaatggctgcctcctgaactacctgagggagatgcgccaccgcttccagactcagcagctgctagagatgtgcaaggatgtctgtgaagccatggaatacctggagtcaaagcagttccttcaccgagacctggtgggaccttagaaggattggcctaggacaaagggctgatggggtggaagtagcagtggaagatatatcatacatggttgaggggggctgctggtgccatcatttcaattttatctagaaagtactataagttaggcgtgcctctgccccagtgctgagcccatcaaatatctccagcctcagctccatgaagtctgccgtggtgggaatcagagcagtcactcactcccaaccccctaccacccacaagaaaatggtggggtctttcagtggccattctggatttggaacagaagggactgtgcttcccaatgggactgctcctggcatggggccatcatttggttccttcagagtcacatactggggcctgtggatgcatttggcccacatgtgtgggttttttttatgttatataataattagcaaacccttaaaaagaaacatttcgcttaaaaaaaaa

SEQ ID NO: 348037 - DNA, 3824 bp, Homo sapiens
agtcatttttccagcgtgaattgatttttaatagcaaaatggcattttacacagaagcagctacattcatggatgaaaacaaaaatccaagtgacgctcctttgttgaatccatgtaaaaatctgatttttaatctacagagaaatttctacccacacattcggtatcccctgggggtaatgacatggaaaacaaacatcttttctggtctgttaaagtaaaacaatgggtccctggatagactctcaagagggcctttgatggaatggaaccagtccccccaccccgaaagcatccccccagctcaatatgtcaccatttacaccagcacagccctcacattgggtccacagcacaacctattaagaaaggattataacacctgttcggattgggaggccaattcctcagctctaagatcctgctcatagcaagcttgatgttcagtagactccaaagcagactgaatgagggaggggtcgaagagaatgtgcctgcttgggctcagcctcctctaatattgtcaagatgcacacacactcttagaatctcacaaccatcgccaatctctatgttggcctagtcccaatccttctgcctctgggaacaaaaggttcattacccaccaaggcatatttttccctctctgggaccaggatcagctcttgcaagcttactccacacttgtatctgccccttgcagccatgcatgacaaatgggctccctccccaatggaattatcttatagacttgcagcctatgactgtgtttcccctgatcttctccagggacttcccaccaccatgggatgacatgttttcaagattgctccccttccgagcctttattttcaccttggtcctctttactttccagtcattgcagagatacttccaactggggtagacatgtatggattctgtttatcaaaagatggaccaaagggtcttcctagtttcaaaaagttctgctcagttgtctaaaatgtggccagaggccattgcaaactcctctgagttccacctgggctggaaaagccaaatggccagcctaaaactcaaatccactaactccctttctcagatcatatccgtcgctccccaaggcctaaggataaaatctaaacttcttggcaaccagacccggcaccatgtccatgtctcctatctcttgctacattccacatgaaccttccagaacctctttggatcctctctgatccccagaaactggtgtccaccactctcgctgcccggaactcatccccacccacactccacccagccacagctcagcttagatgcctccctctccagaaagccaccacagggtggattaggtgtctctctgtccccattccacccccctgcacccaacacactagaattaaagctcctgaagaccaaatggtgtttaactaccactacatccccaatgcctggcacacgcctggcacagagtaggtgcacatcaatcttgtctgtctccttggtgctcccacagacccctgaccaatcataacacccatctcactgaatcactatctacttcaccaactctcccactaggctataaaagcaccatgacgaaaaagcccaggtgcaggtcccagcgcccagagcagtgcctggcacatagtagatccttagcagcatcaagtctttgcagttaaacaaagaggagtttcaggaataggagatgtgagcttcctgctttgagtgaaatggagcaaggcagccactagagatggcaggcaggcacttccgggtgtagactaccccatccaaggtccctgccagcagccaaggcatgttctcaaagctctttctaagacatcttttctctcttgtgccctctgcagctcaggcctctggatcacccttcacccccactgccaactacaattggttagctctgagtccacagttgccagagaaaagggctctcagcaccagactagcattcaacgacccaagcaacctgcctctaaggtgtctgccatgtgctgagacccttatattgacgggaatcctcactgcaacctgtaaggtatcagaactcgcattctaccactgaggaaactgaggttgagagaagtgaggtgacttactcaaactcactcaacaggaagtggcagagctggtgagtcttatttgcattctctgtcctggaacgtgggtctgcacaaagatcccagcccataggcagagccttctggagccttggctgcccccatatcccagccccttgaaaggcccatgagctgcacagttagtaggatctggctgcgggggggtggttagtagggcatgctcgggcctggttagtgggttagttggttggcagaaggccaggcacctcgtcacacgccacagcgtcccggctgagccctgggttagtaggttaatcacaccatgcaacactgccccggcccctccagctgcagcttcagaggcctcccgcccccaccagccagggagtggggcctgaccagggcagggggtctaactctaagccccccagccccatcaaaatcaaccctaaccacatggaccctgaccaaaagcatgttgcttccctatttattggctgtgggtctcagagcaccccctgcaaatatttcagctcccctgaaaatggaccctacttgtcctagacagaaaccccctgcctggttctggtcagccccttcccagagggctggatcctgttacactctgacagacacacgcacaccagcatctctccgcaaaagatctgacaaccgtgcttagtagacatctcttccatcaccgactgtcaggcctctagtttctccaactattggcctgccctcccaccattagaaaaaaaaaaaacgcatcaagctggcctgccaatgctacaaagcacctaagtgtaccctaattatgccatcttctatcactgctgtacttttcccatagaaaccccagcctagcatctcccacagttctaaacgatgttccatgagaaaaagattctacggccataaaagtcaaggaacacttcatcctatgccctgtccctgagtatttgaaattgccattagcattttaaaggttctgataagtcctgcactacttcagtagtgcagcggaatttgaattagaacctgcttttttttttttttttttttttttaaggagcaatgacatttcctagaagttactctaagaatttccctagagggtcgggtatcatctcagccagatctttctcatccttcaaggccctgtttggtacagcttgctaggaagctgttccagactgcagcagccctctctggggtctctctaccacttcccaggcactcagaacttgtgcctcagtagactgttttgtggcactgtcccattctctgattctccatgtgagctggttttatcccatccagcatggctgtgaaatcctaaaggttcaaaccccagccactcttcacctatatttcccccaaatggctagcacgggaaagggcccaaagtaggtgctcagtgctgatgagagagtagaatttaaataccccaggaagcattgtgagttactacggaggccatgaaatgctgccacctccccaagctgattaaagagtgatactaggaaaataggtagggaagggctaatcagaaatgcctctggttcagaagatgctgagttttaaagtccagagagccaaaaaaaaaaaaaatagataaaccctaagtctatactcccagatggatgggagcatttgctgagcacctactgggagtcaggcactgtgctaggcacacaatctcactgaattctccctgcacctgacagg

SEQ ID NO: 348038 - DNA, 3382 bp, Homo sapiens
agtcatttttccagcgtgaattgatttttaatagcaaaatggcattttacacagaagcagctacattcatggatgaaaacaaaaatccaagtgacgctcctttgttgaatccatgtaaaaatctgatttttaatctacagagaaatttctacccacacattcggtatcccctgggggtaatgacatggaaaacaaacatcttttctggtctgttaaagtaaaacaatgggtccctggatagactctcaagagggcctttgatggaatggaaccagtccccccaccccgaaagcatccccccagctcaatatgtcaccatttacaccagcacagccctcacattgggtccacagcacaacctattaagaaaggattataacacctgttcggattgggaggccaattcctcagctctaagatcctgctcatagcaagcttgatgttcagtagactccaaagcagactgaatgagggaggggtcgaagagaatgtgcctgcttgggctcagcctcctctaatattgtcaagatgcacacacactcttagaatctcacaaccatcgccaatctctatgttggcctagtcccaatccttctgcctctgggaacaaaaggttcattacccaccaaggcatatttttccctctctgggaccaggatcagctcttgcaagcttactccacacttgtatctgccccttgcagccatgcatgacaaatgggctccctccccaatggaattatcttatagacttgcagcctatgactgtgtttcccctgatcttctccagggacttcccaccaccatgggatgacatgttttcaagattgctccccttccgagcctttattttcaccttggtcctctttactttccagtcattgcagagatacttccaactggggtagacatgtatggattctgtttatcaaaagatggaccaaagggtcttcctagtttcaaaaagttctgctcagttgtctaaaatgtggccagaggccattgcaaactcctctgagttccacctgggctggaaaagccaaatggccagcctaaaactcaaatccactaactccctttctcagatcatatccgtcgctccccaaggcctaaggataaaatctaaacttcttggcaaccagacccggcaccatgtccatgtctcctatctcttgctacattccacatgaaccttccagaacctctttggatcctctctgatccccagaaactggtgtccaccactctcgctgcccggaactcatccccacccacactccacccagccacagctcagcttagatgcctccctctccagaaagccaccacagggtggattaggtgtctctctgtccccattccacccccctgcacccaacacactagaattaaagctcctgaagaccaaatggtgtttaactaccactacatccccaatgcctggcacacgcctggcacagagtaggtgcacatcaatcttgtctgtctccttggtgctcccacagacccctgaccaatcataacacccatctcactgaatcactatctacttcaccaactctcccactaggctataaaagcaccatgacgaaaaagcccaggtgcaggtcccagcgcccagagcagtgcctggcacatagtagatccttagcagcatcaagtctttgcagttaaacaaagaggagtttcaggaataggagatgtgagcttcctgctttgagtgaaatggagcaaggcagccactagagatggcaggcaggcacttccgggtgtagactaccccatccaaggtccctgccagcagccaaggcatgttctcaaagctctttctaagacatcttttctctcttgtgccctctgcagctcaggcctctggatcacccttcacccccactgccaactacaattggttagctctgagtccacagttgccagagaaaagggctctcagcaccagactagcattcaacgacccaagcaacctgcctctaaggtctgtaagccagcctttgacctgtccctaaactgatccaatcctccaggccctgccttgaactgtcttctcctgcagactctgactaccagactgagtcagcaaaaccttgaactagtgccaccttttacctgcacctggaatcccttgcgtatgctccctgcccctctactcccaaaggacgttccctcagtctaaagagatcaaaagtcccttccagaaaaactcccgtttcctcggtgcagctaaattgcacagaagagtttatgctagaagagctaaaagttagaacaggaagctcagataatttatactactaacatgtaaatgactgacggagttataacccttctgaatactctgatctaaagctttatgtcctagaacttccaaaacacaaagtccccaaaatgaagactctaggccctggcctggggaagggtgactctatacaaaatggcatatgctctgtagacaccagacaggtattttaaggtttataagagctgcatctacttgtgcaaactactgtagctataaggctatatatttttaagaactgaaaccaaatgcagactatgaggagtgaagatatgcccaatggccaaaaccttgcaagactggctatacttctgaccccaccttggtgggtaccactgctccatcaggcctggtccacaccagagccctggcacctcctttagaaaactaccatctttaccgacttctgattgttctgactcagagcagccaccacgcccaaaattgttagctatgcttttccctgtgttagtcaagttcaaacctgtgttagccaagttcaaacctgtgttagccaagttcaaagctgtgttagccccttcccagccatgccgacatccaagctgttaacagtaacgaggaatgttagacctgttgttagtcagaaaaaaatccacaaaccattagtttctgctgaaaggaacagaccaggaaggcaggagttagtcaaggtgaaggaaaggttaattaagaactggtcagggccaggccaggagcctggaacccccagacagggccaggttggttgttagtggtcagcccctggggcagtcagggtgaggcagggattagctgggtgagagcaagagttagcgcaagggagccagagattagcccaaagaaaccaaggtgcctactggaggtgaggcatgaaatcacccccaggtgtggccccggcttagcggctggcgggctctgggggaggctggctgaggcagtgacgtccgtgggaacagagagccagagatgcattcctggccggcctgagcatctgcgggaaccctgtgagcccctgaggttcacttcttgctccccacttctctctcctgcaaactccgagcccggggta

SEQ ID NO: 348039 - DNA, 2545 bp, Homo sapiens
agtcatttttccagcgtgaattgatttttaatagcaaaatggcattttacacagaagcagctacattcatggatgaaaacaaaaatccaagtgacgctcctttgttgaatccatgtaaaaatctgatttttaatctacagagaaatttctacccacacattcggtatcccctgggggtaatgacatggaaaacaaacatcttttctggtctgttaaagtaaaacaatgggtccctggatagactctcaagagggcctttgatggaatggaaccagtccccccaccccgaaagcatccccccagctcaatatgtcaccatttacaccagcacagccctcacattgggtccacagcacaacctattaagaaaggattataacacctgttcggattgggaggccaattcctcagctctaagatcctgctcatagcaagcttgatgttcagtagactccaaagcagactgaatgagggaggggtcgaagagaatgtgcctgcttgggctcagcctcctctaatattgtcaagatgcacacacactcttagaatctcacaaccatcgccaatctctatgttggcctagtcccaatccttctgcctctgggaacaaaaggttcattacccaccaaggcatatttttccctctctgggaccaggatcagctcttgcaagcttactccacacttgtatctgccccttgcagccatgcatgacaaatgggctccctccccaatggaattatcttatagacttgcagcctatgactgtgtttcccctgatcttctccagggacttcccaccaccatgggatgacatgttttcaagattgctccccttccgagcctttattttcaccttggtcctctttactttccagtcattgcagagatacttccaactggggtagacatgtatggattctgtttatcaaaagatggaccaaagggtcttcctagtttcaaaaagttctgctcagttgtctaaaatgtggccagaggccattgcaaactcctctgagttccacctgggctggaaaagccaaatggccagcctaaaactcaaatccactaactccctttctcagatcatatccgtcgctccccaaggcctaaggataaaatctaaacttcttggcaaccagacccggcaccatgtccatgtctcctatctcttgctacattccacatgaaccttccagaacctctttggatcctctctgatccccagaaactggtgtccaccactctcgctgcccggaactcatccccacccacactccacccagccacagctcagcttagatgcctccctctccagaaagccaccacagggtggattaggtgtctctctgtccccattccacccccctgcacccaacacactagaattaaagctcctgaagaccaaatggtgtttaactaccactacatccccaatgcctggcacacgcctggcacagagtaggtgcacatcaatcttgtctgtctccttggtgctcccacagacccctgaccaatcataacacccatctcactgaatcactatctacttcaccaactctcccactaggctataaaagcaccatgacgaaaaagcccaggtgcaggtcccagcgcccagagcagtgcctggcacatagtagatccttagcagcatcaagtctttgcagttaaacaaagaggagtttcaggaataggagatgtgagcttcctgctttgagtgaaatggagcaaggcagccactagagatggcaggcaggcacttccgggtgtagactaccccatccaaggtccctgccagcagccaaggcatgttctcaaagctctttctaagacatcttttctctcttgtgccctctgcagctcaggcctctggatcacccttcacccccactgccaactacaattggttagctctgagtccacagttgccagagaaaagggctctcagcaccagactagcattcaacgacccaagcaacctgcctctaaggtgtctgccatgtgctgagacccttatattgacgggaatcctcactgcaacctgtaaggtatcagaactcgcattctaccactgaggaaactgaggttgagagaagtgaggtgacttactcaaactcactcaacaggaagtggcagagctggtgagtcttatttgcattctctgtcctggaacgtgggtctgcacaaagatcccagcccataggcagagccttctggagccttggctgcccccatatcccagccccttgaaaggcccatgagctgcacagttagtaggatctggctgcgggggggtggttagtagggcatgctcgggcctggttagtgggttagttggttggcagaaggccaggcacctcgtcacacgccacagcgtcccggctgagccctgggttagtaggttaatcacaccatgcaacactgccccggcccctccagctgcagcttcagaggcctcccgcccccaccagccagggtggtggcggcgcctgtaatcccagctactcaggaggctgaggcaggagaattgcttgaacccggga

SEQ ID NO: 348040 - DNA, 2766 bp, Homo sapiens
agtcatttttccagcgtgaattgatttttaatagcaaaatggcattttacacagaagcagctacattcatggatgaaaacaaaaatccaagtgacgctcctttgttgaatccatgtaaaaatctgatttttaatctacagagaaatttctacccacacattcggtatcccctgggggtaatgacatggaaaacaaacatcttttctggtctgttaaagtaaaacaatgggtccctggatagactctcaagagggcctttgatggaatggaaccagtccccccaccccgaaagcatccccccagctcaatatgtcaccatttacaccagcacagccctcacattgggtccacagcacaacctattaagaaaggattataacacctgttcggattgggaggccaattcctcagctctaagatcctgctcatagcaagcttgatgttcagtagactccaaagcagactgaatgagggaggggtcgaagagaatgtgcctgcttgggctcagcctcctctaatattgtcaagatgcacacacactcttagaatctcacaaccatcgccaatctctatgttggcctagtcccaatccttctgcctctgggaacaaaaggttcattacccaccaaggcatatttttccctctctgggaccaggatcagctcttgcaagcttactccacacttgtatctgccccttgcagccatgcatgacaaatgggctccctccccaatggaattatcttatagacttgcagcctatgactgtgtttcccctgatcttctccagggacttcccaccaccatgggatgacatgttttcaagattgctccccttccgagcctttattttcaccttggtcctctttactttccagtcattgcagagatacttccaactggggtagacatgtatggattctgtttatcaaaagatggaccaaagggtcttcctagtttcaaaaagttctgctcagttgtctaaaatgtggccagaggccattgcaaactcctctgagttccacctgggctggaaaagccaaatggccagcctaaaactcaaatccactaactccctttctcagatcatatccgtcgctccccaaggcctaaggataaaatctaaacttcttggcaaccagacccggcaccatgtccatgtctcctatctcttgctacattccacatgaaccttccagaacctctttggatcctctctgatccccagaaactggtgtcctctgcagctcaggcctctggatcacccttcacccccactgccaactacaattggttagctctgagtccacagttgccagagaaaagggctctcagcaccagactagcattcaacgacccaagcaacctgcctctaaggtctgtaagccagcctttgacctgtccctaaactgatccaatcctccaggccctgccttgaactgtcttctcctgcagactctgactaccagactgagtcagcaaaaccttgaactagtgccaccttttacctgcacctggaatcccttgcgtatgctccctgcccctctactcccaaaggacgttccctcagtctaaagagatcaaaagtcccttccagaaaaactcccgtttcctcggtgcagctaaattgcacagaagagtttatgctagaagagctaaaagttagaacaggaagctcagataatttatactactaacatgtaaatgactgacggagttataacccttctgaatactctgatctaaagctttatgtcctagaacttccaaaacacaaagtccccaaaatgaagactctaggccctggcctggggaagggtgactctatacaaaatggcatatgctctgtagacaccagacaggtattttaaggtttataagagctgcatctacttgtgcaaactactgtagctataaggctatatatttttaagaactgaaaccaaatgcagactatgaggagtgaagatatgcccaatggccaaaaccttgcaagactggctatacttctgaccccaccttggtgggtaccactgctccatcaggcctggtccacaccagagccctggcacctcctttagaaaactaccatctttaccgacttctgattgttctgactcagagcagccaccacgcccaaaattgttagctatgcttttccctgtgttagtcaagttcaaacctgtgttagccaagttcaaacctgtgttagccaagttcaaagctgtgttagccccttcccagccatgccgacatccaagctgttaacagtaacgaggaatgttagacctgttgttagtcagaaaaaaatccacaaaccattagtttctgctgaaaggaacagaccaggaaggcaggagttagtcaaggtgaaggaaaggttaattaagaactggtcagggccaggccaggagcctggaacccccagacagggccaggttggttgttagtggtcagcccctggggcagtcagggtgaggcagggattagctgggtgagagcaagagttagcgcaagggagccagagattagcccaaagaaaccaaggtgcctactggaggtgaggcatgaaatcacccccaggtgtggccccggcttagcggctggcgggctctgggggaggctggctgaggcagtgacgtccgtgggaacagagagccagagatgcattcctggccggcctgagcatctgcgggaaccctgtgagcccctgaggttcacttcttgctccccacttctctctcctgcaaactccgagcccggggta

SEQ ID NO: 348041 - DNA, 961 bp, Homo sapiens
agtcatttttccagcgtgaattgatttttaatagcaaaatggcattttacacagaagcagctacattcatggatgaaaacaaaaatccaagtgacgctcctttgttgaatccatgtaaaaatctgatttttaatctacagagaaatttctacccacacattcggtatcccctgggggtaatgacatggaaaacaaacatcttttctggtctgttaaagtaaaacaatgggtccctggatagactctcaagagggcctttgatggaatggaaccagtccccccaccccgaaagcatccccccagctcaatatgtcaccatttacaccagcacagccctcacattgggtccacagcacaacctattaagaaaggattataacacctgttcggattgggaggccaattcctcagctctaagatcctgctcatagcaagcttgatgttcagtagactccaaagcagactgaatgagggaggggtcgaagagaatgtgcctgcttgggctcagcctcctctaatattgtcaagatgcacacacactcttagaatctcacaaccatcgccaatctctatgttggcctagtcccaatccttctgcctctgggaacaaaaggttcattacccaccaaggcatatttttccctctctgggaccaggatcagctcttgcaagcttactccacacttgtatctgccccttgcagccatgcatgacaaatgggctccctccccaatggaattatcttatagacttgcagcctatgactgtgtttcccctgatcttctccagggacttcccaccaccatgggatgacatgttttcaagattgctccccttccgagcctttattttcaccttggtcctctttactttccagtcattgcagagatacttccaactggggtagagagagagagagagagagagagtgagagagagagagagagagccagtgtggaga

SEQ ID NO: 348042 - DNA, 3360 bp, Homo sapiens
ggcaagccagtcttatatgggggttgcagaaaagtccccgttggcaaccctctttgatgtgcacatgcacacacactcttagaatctcacaaccatcgccaatctctatgttggcctagtcccaatccttctgcctctgggaacaaaaggttcattacccaccaaggcatatttttccctctctgggaccaggatcagctcttgcaagcttactccacacttgtatctgccccttgcagccatgcatgacaaatgggctccctccccaatggaattatcttatagacttgcagcctatgactgtgtttcccctgatcttctccagggacttcccaccaccatgggatgacatgttttcaagattgctccccttccgagcctttattttcaccttggtcctctttactttccagtcattgcagagatacttccaactggggtagacatgtatggattctgtttatcaaaagatggaccaaagggtcttcctagtttcaaaaagttctgctcagttgtctaaaatgtggccagaggccattgcaaactcctctgagttccacctgggctggaaaagccaaatggccagcctaaaactcaaatccactaactccctttctcagatcatatccgtcgctccccaaggcctaaggataaaatctaaacttcttggcaaccagacccggcaccatgtccatgtctcctatctcttgctacattccacatgaaccttccagaacctctttggatcctctctgatccccagaaactggtgtccaccactctcgctgcccggaactcatccccacccacactccacccagccacagctcagcttagatgcctccctctccagaaagccaccacagggtggattaggtgtctctctgtccccattccacccccctgcacccaacacactagaattaaagctcctgaagaccaaatggtgtttaactaccactacatccccaatgcctggcacacgcctggcacagagtaggtgcacatcaatcttgtctgtctccttggtgctcccacagacccctgaccaatcataacacccatctcactgaatcactatctacttcaccaactctcccactaggctataaaagcaccatgacgaaaaagcccaggtgcaggtcccagcgcccagagcagtgcctggcacatagtagatccttagcagcatcaagtctttgcagttaaacaaagaggagtttcaggaataggagatgtgagcttcctgctttgagtgaaatggagcaaggcagccactagagatggcaggcaggcacttccgggtgtagactaccccatccaaggtccctgccagcagccaaggcatgttctcaaagctctttctaagacatcttttctctcttgtgccctctgcagctcaggcctctggatcacccttcacccccactgccaactacaattggttagctctgagtccacagttgccagagaaaagggctctcagcaccagactagcattcaacgacccaagcaacctgcctctaaggtgtctgccatgtgctgagacccttatattgacgggaatcctcactgcaacctgtaaggtatcagaactcgcattctaccactgaggaaactgaggttgagagaagtgaggtgacttactcaaactcactcaacaggaagtggcagagctggtgagtcttatttgcattctctgtcctggaacgtgggtctgcacaaagatcccagcccataggcagagccttctggagccttggctgcccccatatcccagccccttgaaaggcccatgagctgcacagttagtaggatctggctgcgggggggtggttagtagggcatgctcgggcctggttagtgggttagttggttggcagaaggccaggcacctcgtcacacgccacagcgtcccggctgagccctgggttagtaggttaatcacaccatgcaacactgccccggcccctccagctgcagcttcagaggcctcccgcccccaccagccagggagtggggcctgaccagggcagggggtctaactctaagccccccagccccatcaaaatcaaccctaaccacatggaccctgaccaaaagcatgttgcttccctatttattggctgtgggtctcagagcaccccctgcaaatatttcagctcccctgaaaatggaccctacttgtcctagacagaaaccccctgcctggttctggtcagccccttcccagagggctggatcctgttacactctgacagacacacgcacaccagcatctctccgcaaaagatctgacaaccgtgcttagtagacatctcttccatcaccgactgtcaggcctctagtttctccaactattggcctgccctcccaccattagaaaaaaaaaaaacgcatcaagctggcctgccaatgctacaaagcacctaagtgtaccctaattatgccatcttctatcactgctgtacttttcccatagaaaccccagcctagcatctcccacagttctaaacgatgttccatgagaaaaagattctacggccataaaagtcaaggaacacttcatcctatgccctgtccctgagtatttgaaattgccattagcattttaaaggttctgataagtcctgcactacttcagtagtgcagcggaatttgaattagaacctgcttttttttttttttttttttttttaaggagcaatgacatttcctagaagttactctaagaatttccctagagggtcgggtatcatctcagccagatctttctcatccttcaaggccctgtttggtacagcttgctaggaagctgttccagactgcagcagccctctctggggtctctctaccacttcccaggcactcagaacttgtgcctcagtagactgttttgtggcactgtcccattctctgattctccatgtgagctggttttatcccatccagcatggctgtgaaatcctaaaggttcaaaccccagccactcttcacctatatttcccccaaatggctagcacgggaaagggcccaaagtaggtgctcagtgctgatgagagagtagaatttaaataccccaggaagcattgtgagttactacggaggccatgaaatgctgccacctccccaagctgattaaagagtgatactaggaaaataggtagggaagggctaatcagaaatgcctctggttcagaagatgctgagttttaaagtccagagagccaaaaaaaaaaaaaatagataaaccctaagtctatactcccagatggatgggagcatttgctgagcacctactgggagtcaggcactgtgctaggcacacaatctcactgaattctccctgcacctgacagg

SEQ ID NO: 348043 - DNA, 1682 bp, Homo sapiens
tttttgtatgcaccacgggcggcggtggtcggtgcgggaggagggaggggagcttgcgggcccgagagggggcgacggcggcggcggtggcctgaggaggcccgagcggcggcggtggcggcgaaggccgaggcgtctaggtgtttttggaagagctgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttccgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccagctcagtgccgccagccatcaacagtattgggagcaatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagaatcagctttgagtaactgtacagtttttctcgctgttggagaagacttatttgttggagtttcacttgtttaatggtctgggcttattttggaaaaaaaaaaaacaaacaaaaaaaacga

SEQ ID NO: 348044 - DNA, 3624 bp, Homo sapiens
gtcccgtgttaggcttggagcatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtgatgggacagacaaaacctccaccatctgacgggacccacagcccagcgcacccataggctccctgggcggcgggcgggggccaacccccaacgggcttctccgcgacagcgagagggtgggctggctcagctatatattctaatatttttctactctcttaccctcttaacttttgtttaacattggcacatgccttgctcactcccaggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttgggaaaaaaacaaaaaaaccaaaaaaaaaaaaaaattttaaaaccaccaccctccctgcactatcaccccattccccagaccttcttgcccccgccctcctggtctgtggacttccctctgctctgagcccagggagggggaagaagccagggggtagggtggccctgggaacctggctctgggtccccacttcctctcccagtgccgggctgggtggggtgtcaggtttatttatgtacctcttgcacactcatcaacctatgcaagtcccccaccccggccctccatgtttctgtgcctttgctcatcccctcaatctcccagggcttctccagtccccctcccactagctgcaggaagtgggatggatgggccacctcgtttggaatcagcagggtgtccctctcatgggaccctcccctctccccagcctgtcctgtcttgttcactctccatcagggtgagctgactgtgcctggcactgggaggtggtgagggacaccgtctcacacacacagggaggcaagagctgccccccaccccacctgacagcagagtgtgcaggacgcaggcggccccactctgatgggcaggaccctgaccctctcccgctccagccccctccccaggccctcctccatgatttcaccctccctacccacttctgtccccggccccactggcagaatcagctttgagtaactgtacagtttttctcgctgttggagaagacttatttgttggagtttcacttgtttaatggtctgggcttattttggaaaaaaaaaaaacaaacaaaaaaaacga

SEQ ID NO: 348045 - DNA, 3068 bp, Homo sapiens
tttttgtatgcaccacgggcggcggtggtcggtgcgggaggagggaggggagcttgcgggcccgagagggggcgacggcggcggcggtggcctgaggaggcccgagcggcggcggtggcggcgaaggccgaggcgtctaggtgtttttggaagagctgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttccgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccaaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttgggaaaaaaacaaaaaaaccaaaaaaaaaaaaaaattttaaaaccaccaccctccctgcactatcaccccattccccagaccttcttgcccccgccctcctggtctgtggacttccctctgctctgagcccagggagggggaagaagccagggggtagggtggccctgggaacctggctctgggtccccacttcctctcccagtgccgggctgggtggggtgtcaggtttatttatgtacctcttgcacactcatcaacctatgcaagtcccccaccccggccctccatgtttctgtgcctttgctcatcccctcaatctcccagggcttctccagtccccctcccactagctgcaggaagtgggatggatgggccacctcgtttggaatcagcagggtgtccctctcatgggaccctcccctctccccagcctgtcctgtcttgttcactctccatcagggtgagctgactgtgcctggcactgggaggtggtgagggacaccgtctcacacacacagggaggcaagagctgccccccaccccacctgacagcagagtgtgcaggacgcaggcggccccactctgatgggcaggaccctgaccctctcccgctccagccccctccccaggccctcctccatgatttcaccctccctacccacttctgtccccggccccactggcagaatcagctttgagtaactgtacagtttttctcgctgttggagaagacttatttgttggagtttcacttgtttaatggtctgggcttattttggaaaaaaaaaaaacaaacaaaaaaaacga

SEQ ID NO: 348046 - DNA, 1883 bp, Homo sapiens
gtcccgtgttaggcttggagcatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccaggtgaggtgccccacccttgggactctgcctggccaacatcctcagctgacctttcttttttctcctgggtctcatgtccactgttcttctagactgcattggcacctctccccatacctcacaccactctgcacccatctcccccaattgtggggggttgttttcctcctctgcttcaattttatctctcaggtcttgcccccacccctctgagtcatcatctctcaccccttactcctaccccatctcatgtttcccaccctatgtcataatcttagtgtctgtgttgctcctttgtcatcatctctttctttacaggatcattgaatactcaacttagaaggggttgaggggatgggacagttaaagtgtgagatttctgtggaggggagtcctgcccatcagcctactgggattctttcagatgccaggtgaccacacaggaaccagtggacttcacctcttagaacaggtgtttgaagtgagagggctgttttgacctctgcttacagaccatcctggagatgggagagcagaagttgggc

SEQ ID NO: 348047 - DNA, 342 bp, Homo sapiens
ccaccccgggaaaatggacacgtgcccttccacccatccagctcagtgccgccagccatcaacagtattgggagcaatgcaaacacaggtaagtggcgggggtgtcccagaaggccatgcctacttgaaaaaggttggactaggctcagtgagagctctctcgctctgtggcattagacaagtcacataagctgtaggcctcaactttatgaggcaatgcagaggctgtgaactggctttcccagagctgaatctgacctacagacatgtcttattgaacccatactttggtttggttttattttgttgtgttgggtttttaaataaatgtgagtggtacaa

SEQ ID NO: 348048 - DNA, 591 bp, Homo sapiens
tggtgacctcctaggagtgggggaccaccaggttgcctaaggaggggtgaactggcccagtttggaaatggagcaggtcaaaactcccgtgctgatcaatagtgggattgcacttgtgaatagccactgcactgcagcctgggcaacatagtgagaccccatctcttaaaaaaaataagacaaaaattactccagaggcagggtcagtgtgtttgatctcacctatatgagggataagtttgggagttatgaaaagaaaatcgttatgaaaagaagattggagctgagggaataggccataggcagtgctctcaggtgaataggagtaccccaccctggctctcctgatatttcttcttatcccttctgtagccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggagg

SEQ ID NO: 348049 - DNA, 365 bp, Homo sapiens
ttaccacccccattctcctctctcccacccagactgcccggttcctgggcctgacctggagatcaatcccactctggagtctctgtgtctgagcatgacagaacacgccttgggtggtgagcatttcctctttccctgacccagctcccacctacccagcgtctctgcctctgaactgagcaactcagagtcatcctgaggggtccccaggggaggccagactccagggagggcctgactgggatgacaggctacctgagtgccttttcttgggcctccctccagctcctgatcttcctcccttcctccctttcttaccacagatgggacagacaaaacctccaccatctgacgggacccacagc

SEQ ID NO: 348050 - DNA, 485 bp, Homo sapiens
atggcatcagaactggcaatgagcaactccgacatgcccaccagtccactggccatggaatatgttaatgacttcgatctgatgaagtttgaagtgaacaaggaaccggtggagaccgtccgcatcatcagccagtgcggccgtctcatcgccgggggctcgctgtcctccacccccatgagcacgccgtacagatgggtgcccccttcccccagcttctcggcgcccagccgagtctggggcaggcagcagaccgcgctcttagaagagtgaccctgaccctctcccgctccagccccctccccaggccctcctccatgatttcaccctccctacccacttctgtccccggccccactggcagaatcagctttgagtaactgtacagtttttctcgctgttggagaagacttatttgttggagtttcacttgtttaatggtctgggcttattttggaaaaaaaaaaaacaaacaaaaaaaacga

SEQ ID NO: 348051 - DNA, 3225 bp, Homo sapiens
gtcccgtgttaggcttggagcatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccagagccgggaccatgtgacggcgctggccctcgccaccgccgtcccccgaccctggccccaggcccggcaccatgatgttccgagaccaggtgggcatcctcgctggctggttcaaaggctggaatgagtgtgagcagacagtggccctcctgtcacttccgaaacgggtcacccgtacccaggcccgcttcctgcagctctgcctggagcactcactggcggactgcaatgacatccacctgctggagtcggaggccaacagtgctgccatcgtcagccagtggcagcaggagtccaaagagaaggtggtgtccctcctgctgtcccaccttcccctgcttcagccaggcaacacagaggccaagtcggagtacatgaggctactgcagaaagtgctggcctactcaatcgagagcaatgctttcatcgaggagagtcgccagctgctttcctatgccctcatccacccagccaccacactggaggaccgcaacgcactggccctctggctgagccacctggaagagcggttggctagtggcttccgctcccggccagagccctcctaccattcacgtcaaggctcagatgagtgggggggccctgcagagctaggccctggggaggcagggccaggctggcaggacaagccaccccgggaaaatggacacgtgcccttccacccatccaaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttgggaaaaaaacaaaaaaaccaaaaaaaaaaaaaaattttaaaaccaccaccctccctgcactatcaccccattccccagaccttcttgcccccgccctcctggtctgtggacttccctctgctctgagcccagggagggggaagaagccagggggtagggtggccctgggaacctggctctgggtccccacttcctctcccagtgccgggctgggtggggtgtcaggtttatttatgtacctcttgcacactcatcaacctatgcaagtcccccaccccggccctccatgtttctgtgcctttgctcatcccctcaatctcccagggcttctccagtccccctcccactagctgcaggaagtgggatggatgggccacctcgtttggaatcagcagggtgtccctctcatgggaccctcccctctccccagcctgtcctgtcttgttcactctccatcagggtgagctgactgtgcctggcactgggaggtggtgagggacaccgtctcacacacacagggaggcaagagctgccccccaccccacctgacagcagagtgtgcaggacgcaggcggccccactctgatgggcaggaccctgaccctctcccgctccagccccctccccaggccctcctccatgatttcaccctccctacccacttctgtccccggccccactggcagaatcagctttgagtaactgtacagtttttctcgctgttggagaagacttatttgttggagtttcacttgtttaatggtctgggcttattttggaaaaaaaaaaaacaaacaaaaaaaacga

SEQ ID NO: 348052 - DNA, 2820 bp, Homo sapiens
gtcccgtgttaggcttggagcatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtgatgggacagacaaaacctccaccatctgacgggacccacagcccagcgcacccataggctccctgggcggcgggcgggggccaacccccaacgggcttctccgcgacagcgagagggtgggctggctcagctatatattctaatatttttctactctcttaccctcttaacttttgtttaacattggcacatgccttgctcactcccaggcccgtcgagggatctctgctgaggcccggggagttgggggcagccaggataaagggggcagggactggccagactgcctgcctctctcctttccttcctcatccccacctggtcccatcccacccctgcctcctccagaccgctgaccacctgcctctccccaagggagcagactccccagagacaaactgaccactaccttgtggagcctgctcagaaacatttgacatttggggtgacgcgcagggcagagaacctgccctccagaatgttattgagaggagctggggagaaggaaggggagcaaggagaggaagctctctctcctctccctgcttccccttcaccattccccacattctgcaaggacaggagccaccttcctctctctcacctcccctggccctgttcaccagaggttctctatgattaatttcttaggcctatttaagatacatatttatatagttcttaacggtttttctctgatcatttcctctcatttttagaatccccaggtctctctcagccaagacagtggcagggagagcctgaactttatgaggggagagggcagagccccctcctccagaccctcaagctctaacccattttcctccagccctggctacccggatgaagaggttggaggtgggcagccagggtagccagtgaggtcaggaagtctgttgccttaacgtccccttccccacgaacacacacccttctccgctcccaggtctggttggtgagacttgggagtcaggaataagggaaaggggattgtttggtttttgggtttttccctaagcccctcccttttctttcagcctttttccttcccccattatgtcatgacctcacttaagtggaacactatatcataacccagagattcgtcccagccccagagtccgacagactgtctggtccctattcctaatgaggggttgtgttggggcccaggtggagggaggggatttgggggttcagactgcggggaagccagggtctccctcttcaacgccctcctccccctcaacccaccttcccaactgggacattctcaagcttttcacaccgaaaaggaaaaaaaatgttatttttagatacattttatgaataacttttgttatgaatatggctggtaaccattgtgtatgttattaaagatacaaaatgttggga

SEQ ID NO: 348053 - DNA, 2355 bp, Homo sapiens
  misc_feature (2153)..(2153): n is a, c, g, or t
gtcccgtgttaggcttggagcatgcaaacacaggtctcccctgccaaatccaccctagcccactgaagcgctccatgtcactcatccctacaagcccccaggtccctggtgagtggccgagtccagaggagcttggggcccgggctgcttttaccacgcccgatcacgcacctctctcgccccagagcagcgtggcctcctctggcagtgagcagacagaggagcagggctccagccggaacaccttccaggaggatggcagtggcatgaaagatgtgccctcatggctcaagagcctccgtttgcacaagtatgcagccctcttctcacagatgagctacgaggagatgatgacactgactgagcagcacctggagtctcagaacgtcaccaaaggtgcccgccacaagatagccctgagcatccagaagctgcgtgagagacagagcgtcctcaagtccctagagaaggatgtgctggaaggcgggaacctacgaaacgctctgcaggagctgcagcagatcatcatcactcccatcaaggcctacagtgtcctccaggccaccgtggctgccgccaccaccacccctactgccaaggatggggccccgggggaaccaccgctgccaggtgctgagcctcccctagcccaccccggcacagacaaaggcaccgaggccaaggaccctccagctgtggagaactacccacctccaccagctccagctcccactgatggcagtgagcctgccccggctcccgtcgccgacggagacatccccagccagtttacacgggtgatgggcaaagtgtgcacccaactgctggtgtcccgaccagacgaggagaacatcaccagttacctccagctcatcgaaaagtgcctgactcatgaggctttcacggagacgcagaagaaacggctgctatcctggaaacagcaagtgctgaagctcctccggacattcccgcgcaaagccgcactagagatgcagaactaccggcagcagaaaggctgggcattcggctccaactcgctccccatagctggctctgtggggatgggagtggcccggcgtacccagcggcagttcccaatgcctccccgggccctcccacccggccggatgggcctcctgagcccctcgggcattgggggtgtctcccctcgacatgccctcaccagccccagccttggaggccagggccgacagaacctgtggtttgccaaccctggaggcagcaacagcatgcccagtcagagccgcagctctgtgcagcgcacccactcgctcccggtccactcgtcaccccaggccattctcatgttccctccagactgcccggttcctgggcctgacctggagatcaatcccactctggagtctctgtgtctgagcatgacagaacacgccttgggtggtgagcatttcctctttccctgacccagctcccacctacccagcgtctctgcctctgaactgagcaactcagagtcatcctgaggggtccccaggggaggccagactccagggagggcctgactgggatgacaggctacctgagtgccttttcttgggcctccctccagctcctgatcttcctcccttcctccctttcttaccacagatgggacagacaaaacctccaccatctgacgggacccacagcccagcgcacccataggctccctgggcggcgggcgggggccaacccccaacgggcttctccgcgacagcgagagggtgggctggctcagctatatattctaatatttttctactctcttaccctcttaacttttgtttaacattggcacatgccttgctcactcccaggcccgtcgagggatctctgctgaggcccggggagttgggggcagccaggataaagggggcaggactggccagactgcctgctctctcctttccttcctcatcccacctggtcccatcccacccctgcctcctccagaccgctgaccacctgcctctccccaagggagcagactccccagagacaaactgaccactaccttgtggagcctgctcgaacctttgacatttggggtgacgcgcagggcagagaacctgccctccagaatgttattgagaggagctggggagaaggaaggggagctatttttttataangattattccactctagccttcccaacattcttagtgtttctctacataaaggacatctggttgggggctcattgtccggactccctcttaacccactttctgatggtgtttgaggccgaacatgatgccaccacctgctaagaggtggcctttttggttcttttgtatgggctcgtcaaagcgcttccaaatgcttgatttc

SEQ ID NO: 348054 - DNA, 637 bp, Homo sapiens
ccagcgctaaaagagggggaggccgagccaagaggaccccaggagcccagagcagcgggagagggtccttcctagcctcggcccgccgggtcggttcctggctggtgtctgctgagggagtggggggcccagccccttctcttctcccccgccaaaccacagtgggagctggggcagggggagagccaggcaatcgggggccaaagatgggggtgctcgcctacagtctgcatctgtagtgccttgtggggtatccaggaacaccctcccagcaggggatgggaaccctgtcccatgaagccctctcctcagctttacttgctcccccgcccttagccttggggagaaatggcccgtggtgggctgaccccccaccctccacacacacagttccatgacccagcgggcccccaggggcatcaggtgctggtcctcctccctcctggcctcgacccctaagggcttcgcccctcccaggggcctgtaactaagtcgggtcctgccaggcagggggcctgtgttctgtgccccttgggagacaggaactggcgagttcaggtggggtggggacagcacagactgttccaccgttgtgcatattgttgcttctgaaccacaaactgtataaatggatggt

SEQ ID NO: 348055 - DNA, 393 bp, Homo sapiens
tcaaccgctccctggaggaggaggagagccagctgtaggggcgggggcgggcagggaggtatttatttatttattcgcaacagccagcgctaaaagagggggaggccgagccaagaggaccccaggagcccagagcagcgggagagggtccttcctagcctcggcccgccgggtcggttcctggctggtgtctgctgagggagtggggggcccagccccttctcttctcccccgccaaaccacagtgggagctggggcagggggagagccaggcaatcgggggccaaagatgggggtgctcgcctacagtctgcatctgtagtgccttgtggggtatccaggaacaccctcccagcaggggatgggaaccctgtcccatgaagccctctcctc

SEQ ID NO: 348056 - DNA, 445 bp, Homo sapiens
ctcagagctggccctcggcagccttacatggtgatcgtctggtcccgctaagccgcgccttggaggctctgctgtgggagcctagcaagtgtttatttttagaagctcttactccaacaccagggctgggcccaaataacacatgtattttagtggttcaaaaatacaagtttatggtaagtcattcgatgtggagaaagtgccaaaccagtgagtgcagtgagaggtttcctggggccacgggcctcctcctgcaggtggcccaggtgcacttgactagctggagcgtgtggctataatcccaggaaatgtatccctcctctcggagggactcgggctcaggagcacacactgaagatgggaggccaggacccagagtgtgaccgtcctggccctaggagggcagggcagcctttggtttgctatcagagcctcgaggcctggc

SEQ ID NO: 348057 - DNA, 351 bp, Homo sapiens
actatcaagaaaggaataaaatatcttgtgaagataatattttaacagaggaaattgggagggtatcagccaagcgttgccagctcagagaacaggtggcttagaaagcaacaagtaaagcagggcccccaagaaattctaaaaacagctggagaatcagaggaactttcacactgctgtgggaatgctaagtggcacggccactttggaaaagtttttggcagttgctaaaaaagttatacatacacctactccatgatccagcaattctactcctaggtatttacccaagagaaacgaaagcctgtgtctatacaaagacttgtacatataaggtgcagtggctcatgc

SEQ ID NO: 348058 - DNA, 1631 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagcca

SEQ ID NO: 348059 - DNA, 1297 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgacttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgcagtgactcacacctgtaatcccagaaattttgggaggctgaggcaggaagatcatatggggccaggagttcaagaccagcctcagggagaccgtcttcacaaaaaataaagaaaaaagaaaaccacgttcccgtgggacagtgagatgctacgttggggatctatgtggacatgttgggggagtcgtgttgtaatgggggcaacgctaggctgc

SEQ ID NO: 348060 - DNA, 574 bp, Homo sapiens
cacatattttactttaaaagcaggtcccatattaaggcctgcttgttaaaattgccactaaagaagaaaatattgtgcaatttgtataggtaaaccatgtaagtttagataacatctgttgtaaagtctacaaatgttaacatagccaagagttggtatttgagaaaaaggtttcagtacagggtgtgaacaatgaaaaattataaaggcatgtaataaaaatgttccataaagacaaagatacctcaagcaggtccacctatacctctagtttagtttagaaactaattcagtattttaagaatcatataattttaaactttgcactaagcctaacctttttaaaaaatggtcaggtgcagtgactcacacctgtaatcccagaaattttgggaggctgaggcaggaagatcatatggggccaggagttcaagaccagcctcagggagaccgtcttcacaaaaaataaagaaaaaagaaaaccacgttcccgtgggacagtgagatgctacgttggggatctatgtggacatgttgggggagtcgtgttgtaatgggggcaacgctaggctgc

SEQ ID NO: 348061 - DNA, 493 bp, Homo sapiens
ggggactttggctgagttgaggtctctggctcaggagggtcaaggcagacctctatcgggagtcccctttcctaaaccggccaaacacaaactcttcctcaagtgctaccttgacctcagggttgcaacggggagctattaaacgcaggacaggggtgccataggtaaaccccaacgctggggcgccagaagtgagggggaccagacagcccaggcagggggtcgcgggctttatactttcccagggctctgcctgtgggagccgtgtgctgctgcaagggattctgggaagtgtaggcttggcgctctcagtgcattctgggagatgcagtctccaaggcacacagaccttgccagttgacatgtgttgcagttcagtttaccgagataatttaatcacaacctcaaactcaggaaagggcaccccagcagactgtaacagggacaaccctggagctgagcctgagaatcctgtgctgtggatccagcttcc

SEQ ID NO: 348062 - DNA, 3551 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctcaaaaagttctagtgatgattaatattactggggatggggtcacctgccctgagctgcaggagagcatggggtgtctgaacaccaggtgagggggaaccggtgagggtttggggcccagggatagactgagctttcctcactgggtcctctgcagccggccatggctagcaccatgcgctctgctgccggagcaccgtgaggcccagaaacactgggcaggcggcatccctgtcctttcggtccccaaccccgttcctctgagagggtctgggcaggctggacgggtagagaggtggccggggggatgaattcattcagttctttattggtaatctgccccttaacttagggtctccctgagctgcacagaaagacctgatacctactgggaccaggcagggggcacagagatggtccttgtcccagcgtacatttcccctgcccacttcagggcttatgttctggcactgagacttcgtggggtacctgtatcttcaagatctagatctcatcattctccacttgaacaatgtgcacctcaaagtcattttgggtgttcttagactccagtgtttcccctggaagttccttggcctcctctccattctccctggcctctgcctggcccccagcttcccctctgggcccgggggcatctccttcagcctctgcctggcccccagcttcccctctgggcccaggggcatctcctttagcctctgcctggccctcagcttcccctctgggccctggaacatctccatcagcctctgcctggcccccaggctcctggacaggatccaaagactcccttctggcctctacctggccctttctaatagggactgccttccaacagcttgtggctcctgaggagatggagcaaggggctctccgggctccacgtgcctgagggctactcccgggaagttgatgagctcagcaggggtcatgagcccatccccattcaggtcctgggtctcgagcactttgtccactatcaagatcacctgtggaagcagagtcactgtggggtctccagggacagagatgttcccaggagttctgaccctccctaacacacccttgcatccctgccgtgcaagctctgagccct

SEQ ID NO: 348063 - DNA, 3542 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagcacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctcaaaaagttctagtgatgattaatattactggggatggggtcacctgccctgagctgcaggagagcatggggtgtctgaacaccaggtgagggggaaccggtgagggtttggggcccagggatagactgagctttcctcactgggtcctctgcagccggccatggctagcaccatgcgctctgctgccggagcaccgtgaggcccagaaacactgggcaggcggcatccctgtcctttcggtccccaaccccgttcctctgagagggtctgggcaggctggacgggtagagaggtggccggggggatgaattcattcagttctttattggtaatctgccccttaacttagggtctccctgagctgcacagaaagacctgatacctactgggaccaggcagggggcacagagatggtccttgtcccagcgtacatttcccctgcccacttcagggcttatgttctggcactgagacttcgtggggtacctgtatcttcaagatctagatctcatcattctccacttgaacaatgtgcacctcaaagtcattttgggtgttcttagactccagtgtttcccctggaagttccttggcctcctctccattctccctggcctctgcctggcccccagcttcccctctgggcccgggggcatctccttcagcctctgcctggcccccagcttcccctctgggcccaggggcatctcctttagcctctgcctggccctcagcttcccctctgggccctggaacatctccatcagcctctgcctggcccccaggctcctggacaggatccaaagactcccttctggcctctacctggccctttgcttcttctctgggaccaggggcttcctgtgtttcttgtcttaatgggcttttagctaatagggactgccttccaacagcttgtggctcctgaggagatggagcaaggggctctccgggctccacgtgcctgagggctactcccgggaagttgatgagctcagcaggggtcatgagcccatccccattcaggtcctgggtctcgagcactttgtccactatcaagatcaccgggttggtggtaggagagttggcagctccaggggccagagcagctgtcaacatggacagcagctccaggccatccagctgtccactctggtcatagtcat

SEQ ID NO: 348064 - DNA, 3600 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgacttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctcaaaaagttctagtgatgattaatattactggggatggggtcacctgccctgagctgcaggagagcatggggtgtctgaacaccaggtgagggggaaccggtgagggtttggggcccagggatagactgagctttcctcactgggtcctctgcagccggccatggctagcaccatgcgctctgctgccggagcaccgtgaggcccagaaacactgggcaggcggcatccctgtcctttcggtccccaaccccgttcctctgagagggtctgggcaggctggacgggtagagaggtggccggggggatgaattcattcagttctttattggtaatctgccccttaacttagggtctccctgagctgcacagaaagacctgatacctactgggaccaggcagggggcacagagatggtccttgtcccagcgtacatttcccctgcccacttcagggcttatgttctggcactgagacttcgtggggtacctgtatcttcaagatctagatctcatcattctccacttgaacaatgtgcacctcaaagtcattttgggtgttcttagactccagtgtttcccctggaagttccttggcctcctctccattctccctggcctctgcctggcccccagcttcccctctgggcccgggggcatctccttcagcctctgcctggcccccagcttcccctctgggcccaggggcatctcctttagcctctgcctggccctcagcttcccctctgggccctggaacatctccatcagcctctgcctggcccccaggctcctggacaggatccaaagactcccttctggcctctacctggccctttgcttcttctctgggaccaggggcttcctgtgtttcttgtcttaatgggcttttagctaatagggactgccttccaacagcttgtggctcctgaggagatggagcaaggggctctccgggctccacgtgcctgagggctactcccgggaagttgatgagctcagcaggggtcatgagcccatccccattcaggtcctgggtctcgagcactttgtccactatcaagatcaccgggttggtggtaggagagttggcagctccaggggccagagcagctgtcaacatggacagcagctccaggccatccagctgtccactctggtcatagtcat

SEQ ID NO: 348065 - DNA, 3735 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacagcttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctcaaaaagttctagtgatgattaatattactggggatggggtcacctgccctgagctgcaggagagcatggggtgtctgaacaccaggtgagggggaaccggtgagggtttggggcccagggatagactgagctttcctcactgggtcctctgcagccggccatggctagcaccatgcgctctgctgccggagcaccgtgaggcccagaaacactgggcaggcggcatccctgtcctttcggtccccaaccccgttcctctgagagggtctgggcaggctggacgggtagagaggtggccggggggatgaattcattcagttctttattggtaatctgccccttaacttagggtctccctgagctgcacagaaagacctgatacctactgggaccaggcagggggcacagagatggtccttgtcccagcgtacatttcccctgcccacttcagggcttatgttctggcactgagacttcgtggggtacctgtatcttcaagatctagatctcatcattctccacttgaacaatgtgcacctcaaagtcattttgggtgttcttagactccagtgtttcccctggaagttccttggcctcctctccattctccctggcctctgcctggcccccagcttcccctctgggcccgggggcatctccttcagcctctgcctggcccccagcttcccctctgggcccaggggcatctcctttagcctctgcctggccctcagcttcccctctgggccctggaacatctccatcagcctctgcctggcccccaggctcctggacaggatccaaagactcccttctggcctctacctggccctttgcttcttctctgggaccaggggcttcctgtgtttcttgtcttaatgggcttttagctaatagggactgccttccaacagcttgtggctcctgaggagatggagcaaggggctctccgggctccacgtgcctgagggctactcccgggaagttgatgagctcagcaggggtcatgagcccatccccattcaggtcctgggtctcgagcactttgtccactatcaagatcaccgggttggtggtaggagagttggcagctccaggggccagagcagctgtcaacatggacagcagctccaggccatccagctgtccactctggtcatagtcat

SEQ ID NO: 348066 - DNA, 3465 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgagagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctcaaaaagttctagtgatgattaatattactggggatggggtcacctgccctgagctgcaggagagcatggggtgtctgaacaccaggtgagggggaaccggtgagggtttggggcccagggatagactgagctttcctcactgggtcctctgcagccggccatggctagcaccatgcgctctgctgccggagcaccgtgaggcccagaaacactgggcaggcggcatccctgtcctttcggtccccaaccccgttcctctgagagggtctgggcaggctggacgggtagagaggtggccggggggatgaattcattcagttctttattggtaatctgccccttaacttagggtctccctgagctgcacagaaagacctgatacctactgggaccaggcagggggcacagagatggtccttgtcccagcgtacatttcccctgcccacttcagggcttatgttctggcactgagacttcgtggggtacctgtatcttcaagatctagatctcatcattctccacttgaacaatgtgcacctcaaagtcattttgggtgttcttagactccagtgtttcccctggaagttccttggcctcctctccattctccctggcctctgcctggcccccagcttcccctctgggcccgggggcatctccttcagcctctgcctggcccccagcttcccctctgggcccaggggcatctcctttagcctctgcctggccctcagcttcccctctgggccctggaacatctccatcagcctctgcctggcccccaggctcctggacaggatccaaagactcccttctggcctctacctggccctttgcttcttctctgggaccaggggcttcctgtgtttcttgtcttaatgggcttttagctaatagggactgccttccaacagcttgtggctcctgaggagatggagcaaggggctctccgggctccacgtgcctgagggctactcccgggaagttgatgagctcagcaggggtcatgagcccatccccattcaggtcctgggtctcgagcactttgtccactatcaagatcaccgggttggtggtaggagagttggcagctccaggggccagagcagctgtcaacatggacagcagctccaggccatccagctgtccactctggtcatagtcat

SEQ ID NO: 348067 - DNA, 3348 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctcaaaaagttctagtgatgattaatattactggggatggggtcacctgccctgagctgcaggagagcatggggtgtctgaacaccaggtgagggggaaccggtgagggtttggggcccagggatagactgagctttcctcactgggtcctctgcagccggccatggctagcaccatgcgctctgctgccggagcaccgtgaggcccagaaacactgggcaggcggcatccctgtcctttcggtccccaaccccgttcctctgagagggtctgggcaggctggacgggtagagaggtggccggggggatgaattcattcagttctttattggtaatctgccccttaacttagggtctccctgagctgcacagaaagacctgatacctactgggaccaggcagggggcacagagatggtccttgtcccagcgtacatttcccctgcccacttcagggcttatgttctggcactgagacttcgtggggtacctgtatcttcaagatctagatctcatcattctccacttgaacaatgtgcacctcaaagtcattttgggtgttcttagactccagtgtttcccctggaagttccttggcctcctctccattctccctggcctctgcctggcccccagcttcccctctgggcccgggggcatctccttcagcctctgcctggcccccagcttcccctctgggcccaggggcatctcctttagcctctgcctggccctcagcttcccctctgggccctggaacatctccatcagcctctgcctggcccccaggctcctggacaggatccaaagactcccttctggcctctacctggccctttgcttcttctctgggaccaggggcttcctgtgtttcttgtcttaatgggcttttagctaatagggactgccttccaacagcttgtggctcctgaggagatggagcaaggggctctccgggctccacgtgcctgagggctactcccgggaagttgatgagctcagcaggggtcatgagcccatccccattcaggtcctgggtctcgagcactttgtccactatcaagatcaccgggttggtggtaggagagttggcagctccaggggccagagcagctgtcaacatggacagcagctccaggccatccagctgtccactctggtcatagtcat

SEQ ID NO: 348068 - DNA, 1432 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacagcttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgcagtgactcacacctgtaatcccagaaattttgggaggctgaggcaggaagatcatatggggccaggagttcaagaccagcctcagggagaccgtcttcacaaaaaataaagaaaaaagaaaaccacgttcccgtgggacagtgagatgctacgttggggatctatgtggacatgttgggggagtcgtgttgtaatgggggcaacgctaggctgc

SEQ ID NO: 348069 - DNA, 409 bp, Homo sapiens
acaatttacaaggctgtattctattatatataagcatcgataaaaatatgcttctggcgtgcagtgactcacacctgtaatcccagaaattttgggaggctgaggcaggaagatcatatggggccaggagttcaagaccagcctcagggagaccgtcttcacaaaaaataaagaaaaaagaaaaccacgttcccgtgggacagtgagatgctacgttggggatctatgtggacatgttgggggagtcgtgttgtaatgggggcaacgctaggctgctgttggtgaatgacgagttagaagtgaccaccagcttctcttccactgcccacaggtgtttgtcagcaaagatgtggccaagcacttggggttccagtcagcagaggaagccttgaggggcttgtatggtcgt

SEQ ID NO: 348070 - DNA, 431 bp, Homo sapiens
ttgcagttcagtttaccgagataatttaatcacaacctcaaactcaggaaagggcaccccagcagactgtaacagggacaaccctggagctgagcctgagaatcctgtgctgtggatccagcttcctgtcatgctgccagcagtgcaggcacagggtccacagctgccagttagagatcctggctctgcctgaccccatcatgctccttcttctctgtcttttccatcctgtgacctaggagcctgccagatgtgtctgctacagactttgagaaggttgatctgacccagttcaagtggatccacattgaggtaagccctgccttacctgtgtttcaaggggctcaacctgccagcctcctccacatgttctgcctccttggtttctttgaatcatgaagtaccttagagataaatgaacccaaccccct

SEQ ID NO: 348071 - DNA, 1170 bp, Homo sapiens
  misc_feature (1033)..(1033): n is a, c, g, or t
  misc_feature (1035)..(1035): n is a, c, g, or t
  misc_feature (1037)..(1038): n is a, c, g, or t
  misc_feature (1041)..(1041): n is a, c, g, or t
  misc_feature (1044)..(1044): n is a, c, g, or t
  misc_feature (1046)..(1046): n is a, c, g, or t
  misc_feature (1051)..(1051): n is a, c, g, or t
  misc_feature (1060)..(1060): n is a, c, g, or t
  misc_feature (1063)..(1063): n is a, c, g, or t
  misc_feature (1073)..(1074): n is a, c, g, or t
  misc_feature (1076)..(1076): n is a, c, g, or t
  misc_feature (1086)..(1088): n is a, c, g, or t
  misc_feature (1097)..(1098): n is a, c, g, or t
  misc_feature (1108)..(1108): n is a, c, g, or t
  misc_feature (1110)..(1110): n is a, c, g, or t
  misc_feature (1117)..(1117): n is a, c, g, or t
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtganancnnganagncnctcanctgtttgcnagnaagtgtgttnnanaaaagtgcannnttgggtcannacaaagaacntnaggcttnttgtgtttagaaggcttctttttttctgctagaggccgacctggcctatgaat

SEQ ID NO: 348072 - DNA, 3600 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctcaaaaagttctagtgatgattaatattactggggatggggtcacctgccctgagctgcaggagagcatggggtgtctgaacaccaggtgagggggaaccggtgagggtttggggcccagggatagactgagctttcctcactgggtcctctgcagccggccatggctagcaccatgcgctctgctgccggagcaccgtgaggcccagaaacactgggcaggcggcatccctgtcctttcggtccccaaccccgttcctctgagagggtctgggcaggctggacgggtagagaggtggccggggggatgaattcattcagttctttattggtaatctgccccttaacttagggtctccctgagctgcacagaaagacctgatacctactgggaccaggcagggggcacagagatggtccttgtcccagcgtacatttcccctgcccacttcagggcttatgttctggcactgagacttcgtggggtacctgtatcttcaagatctagatctcatcattctccacttgaacaatgtgcacctcaaagtcattttgggtgttcttagactccagtgtttcccctggaagttccttggcctcctctccattctccctggcctctgcctggcccccagcttcccctctgggcccgggggcatctccttcagcctctgcctggcccccagcttcccctctgggcccaggggcatctcctttagcctctgcctggccctcagcttcccctctgggccctggaacatctccatcagcctctgcctggcccccaggctcctggacaggatccaaagactcccttctggcctctacctggccctttgcttcttctctgggaccaggggcttcctgtgtttcttgtcttaatgggcttttagctaatagggactgccttccaacagcttgtggctcctgaggagatggagcaaggggctctccgggctccacgtgcctgagggctactcccgggaagttgatgagctcagcaggggtcatgagcccatccccattcaggtcctgggtctcgagcactttgtccactatcaagatcaccgggttggtggtaggagagttggcagctccaggggccagagcagctgtcaacatggacagcagctccaggccatccagctgtccactctggtcatagtcat

SEQ ID NO: 348073 - DNA, 1727 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccaaatatcaagaacatcgcacacaaaacaacacaaataacaacacaaacacaaaacagggggcggctaaaaaataccccgagacccaaataaagtaca

SEQ ID NO: 348074 - DNA, 2577 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacaggagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtgcacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctcaaaaagttctagtgatgattaatattactggggatggggtcacctgccctgagctgcaggagagcatggggtgtctgaacaccaggtgagggggaaccggtgagggtttggggcccagggatagactgagctttcctcactgggtcctctgcagccggccatggctagcaccatgcgctctgctgccggagcaccgtgaggcccagaaacactgggcaggcggcatccctgtcctttcggtccccaaccccgttcctctgagagggtctgggcaggctggacgggtagagaggtggccggggggatgaattcattcagttctttattggtaatctgccccttaacttagggtctccctgagctgcacagaaagacctgatacctactgggaccaggcagggggcacagagatggtccttgtcccagcgtacatttcccctgcccacttcagggcttatgttctggcactgagacttcgtggggtacctgtatcttcaagatctagatctcatcattctccacttgaacaatgtgcacctcaaagtcattttgggtgttcttagactccagtgtttcccctggaagttccttggcctcctctccattctccctggcctctgcctggcccccagcttcccctctgggcccgggggcatctccttcagcctctgcctggcccccagcttcccctctgggcccaggggcatctcctttagcctctgcctggccctcagcttcccctctgggccctggaacatctccatcagcctctgcctggcccccaggctcctggacaggatccaaagactcccttctggcctctacctggccctttgcttcttctctgggaccaggggcttcctgtgtttcttgtcttaatgggcttttagctaatagggactgccttccaacagcttgtggctcctgaggagatggagcaaggggctctccgggctccacgtgcctgagggctactcccgggaagttgatgagctcagcaggggtcatgagcccatccccattcaggtcctgggtctcgagcactttgtccactatcaagatcaccgggttggtggtaggagagttggcagctccaggggccagagcagctgtcaacatggacagcagctccaggccatccagctgtccactctggtcatagtcat

SEQ ID NO: 348075 - DNA, 1766 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacagcttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagcca

SEQ ID NO: 348076 - DNA, 1862 bp, Homo sapiens
ggcggggccgccgcgaccgcgggcttcaggcagggctgcagatgcgcggcccagctgtacctcgcgtgtcccgggtcgggagtcggagacgcaggtgcaggagagtgcggggcaagtagcgcattttctctttgcattctcgagatcgcttagccgcgctttaaaaaggtttgcatcagctgtgagtccatctgacaagcgaggaaactaaggctgagaagtgggaggcgttgccatctgcaggcccaggcaacctgctacgggaagaccggggaccaagacctctgggttggctttcctagacccgctcgggtcttcgggtgtcgcgaggaagggccctgctcctttcgttccctgcacccctggccgctgcaggtggctccctggaggaggagctcccacgcggaggaggagccagggcagctgggagcggggacaccatcctcctggataagaggcagaggccgggaggaaccccgtcagccgggcgggcaggaagctctgggagtagcctcatggaagagaagcagatcctgtgcgtggggctagtggtgctggacgtcatcagcctggtggacaagtaccctaaggaggactcggagataaggtgtttgtcccagagatggcagcgcggaggcaacgcgtccaactcctgcaccattctctccctgctcggagccccctgtgccttcatgggctcaatggctcctggccatgttgctgattttgtcctggatgacctccgccgctattctgtggacctacgctacacagtctttcagaccacaggctccgtccccatcgccacggtcatcatcaacgaggccagtggtagccgcaccatcctatactatgacagcttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccaaatatcaagaacatcgcacacaaaacaacacaaataacaacacaaacacaaaacagggggcggctaaaaaataccccgagacccaaataaagtaca

SEQ ID NO: 348077 - DNA, 3011 bp, Homo sapiens
cagaacaggactcttcttctcttagaggctcgtgtgctccagcaccctctccccactccttttggaggtccagaccacttccaggctctaatctgtgtctccttgcccttttcctggcccggcctccaccctaagcttcctggtggccgacttcaggcggcggggcgtggacgtgtctcaggtggcctggcagagcaagggggacacccccagctcctgctgcatcatcaacaactccaatggcaaccgtaccattgtgctccatgacacgagcctgccagatgtgtctgctacagactttgagaaggttgatctgacccagttcaagtggatccacattgagggccggaacgcatcggagcaggtgaagatgctgcagcggatagacgcacacaacaccaggcagcctccagagcagaagatccgggtgtccgtggaggtggagaagccacgagaggagctcttccagctgtttggctacggagacgtggtgtttgtcagcaaagatgtggccaagcacttggggttccagtcagcagaggaagccttgaggggcttgtatggtcgtgtgaggaaaggggctgtgcttgtctgtgcctgggctgaggagggcgccgacgccctgggccctgatggcaaattgctccactcggatgctttcccgccaccccgcgtggtggatacactgggagctggagacaccttcaatgcctccgtcatcttcagcctctcccaggggaggagcgtgcaggaagcactgagattcgggtgccaggtggccggcaagaagtgtggcctgcagggctttgatggcatcgtgtgagagcaggtgccggctcctcacacaccatggagactaccattgcggctgcatcgccttctcccctccatccagcctggcgtccaggttgccctgttcaggggacagatgcaagctgtggggaggactctgcctgtgtcctgtgttccccacagggagaggctctggggggatggctgggggatgcagagcctcagagcaaataaatcttcctcagagccagcttctcctctcaatgtctgaactgctctggctgggcattcctgaggctctgactcttcgatcctccctctttgtgtccattccccaaattaacctctccgcccaggcccagaggaggggctgcctgggctagagcagcgagaagtgccctgggcttgccaccagctctgccctggctggggaggacactcggtgccccacacccagtgaacctgccaaagaaaccgtgagagctcttcggggccctgcgttgtgcagactctattcccacagctcagaagctgggagtccacaccgctgagctgaactgacaggccagtggggggcaggggtgcgcctcctctgccctgcccaccagcctgtgatttgatggggtcttcattgtccagaaatacctcctcccgctgactgccccagagcctgaaagtctcacccttggagcccaccttggaattaagggcgtgcctcagccacaaatgtgacccaggatacagagtgttgctgtcctcagggaggtccgatctggaacacatattggaattggggccaactccaatatagggtgggtaaggccttataatgtaaagagcatataatgtaaagggctttagagtgagacagacctggattcaaatctgccatttaattagctgcatatcaccttagggtacagcacttaacgcaatctgcctcaatttcttcatctgtcaaatggaaccaattctgcttggctacagaattattgtgaggataaaatcatatataaaatgcccagcatgatgcctgatgtgtacaaggctctcaaaaagttctagtgatgattaatattactggggatggggtcacctgccctgagctgcaggagagcatggggtgtctgaacaccaggtgagggggaaccggtgagggtttggggcccagggatagactgagctttcctcactgggtcctctgcagccggccatggctagcaccatgcgctctgctgccggagcaccgtgaggcccagaaacactgggcaggcggcatccctgtcctttcggtccccaaccccgttcctctgagagggtctgggcaggctggacgggtagagaggtggccggggggatgaattcattcagttctttattggtaatctgccccttaacttagggtctccctgagctgcacagaaagacctgatacctactgggaccaggcagggggcacagagatggtccttgtcccagcgtacatttcccctgcccacttcagggcttatgttctggcactgagacttcgtggggtacctgtatcttcaagatctagatctcatcattctccacttgaacaatgtgcacctcaaagtcattttgggtgttcttagactccagtgtttcccctggaagttccttggcctcctctccattctccctggcctctgcctggcccccagcttcccctctgggcccgggggcatctccttcagcctctgcctggcccccagcttcccctctgggcccaggggcatctcctttagcctctgcctggccctcagcttcccctctgggccctggaacatctccatcagcctctgcctggcccccaggctcctggacaggatccaaagactcccttctggcctctacctggccctttgcttcttctctgggaccaggggcttcctgtgtttcttgtcttaatgggcttttagctaatagggactgccttccaacagcttgtggctcctgaggagatggagcaaggggctctccgggctccacgtgcctgagggctactcccgggaagttgatgagctcagcaggggtcatgagcccatccccattcaggtcctgggtctcgagcactttgtccactatcaagatcaccgggttggtggtaggagagttggcagctccaggggccagagcagctgtcaacatggacagcagctccaggccatccagctgtccactctggtcatagtcat

SEQ ID NO: 348078 - DNA, 1898 bp, Homo sapiens
tttgatatgcctgcattttggaaaaaaaaattgaggatttagcccagtcgctttcccttgatatagccttgttctgaattaaaatggaaaaaatatttcaattattttcatcttgttctcaactggatgttagtcaatgtggtctctttttgaatatgtatcaaatattaatgatccataatattagggagataattttaaatgaagtgatacgtgtctaacttacttaaagaataagtttttggtttttgcttttaaagacaaccaaatctgatattgttcatcctgataaaaataacaacttttagtgcttaaagcattaattaagcaagtggctaggtatgataaagaacttctgcttgctccccaagaggcaaactattagaagaactggagcgggagtcctttggacccatcgtggatctctttaagccactgctacccaaaaacattcaggacaagcaaacatttagagcaagaatctccaaattcttcaggatttgtaatgaaatgatgttcagttccattttgctctttacatagggtggagaattgtcatgtcttctctaatttttccaagtaaagtggtagcaaaatgttttaaaaagcaatcttatattagaaaacaaaaatgttgtcacttgaaataccaaaacaacatttctgagcgttgttgagggactggcaaagcaatcagctactataacaaatcagtagaaataaccctcccacaccagatatgcatgcagaaggaatggagtattatagagacttgatacaatggacatatgcacatggaggtacaaaacacacagtctaaatacaaatgaattccatcagatttactatacggaacatcagtagtgacagattgcacttcttacttaataacagcaaacttaatttctgaggggaaaaaaatggcgaagtcttatcccaaacaaatagcaagagaggtatcatcaaagagctaaaattttctttggcatggtaaagggggaaattgagtttaccaacttatttacatgacatttctctatattggtgagtaatgcaatgccattttgttacataaagttgtttgatgttttttaatatgccttcatataaatattttattcaatatgttgtatttgtgaatttaacaaatgatattaaacacaaactacaatgcagacagacaaactctttgtatgcaaattagcaatacataccaacagttcttgatacacaggtacctactacatgcagctcatcattgctgtcctcttcccatgctacaggtgagaccagacacaaagtaaatgacctaactcaattacaaataacaaggacccctctgcaatatgtctaaacatatattagaagaaagtatttgacatccttcatagggataaatgcccttatagacaccccatatataaaacacaacagagatacacatttacataaatctcagtcatttacaaaaataaatcttgtcttaatttaaaccaataaacagacttgcaggggaaaaagaaaccagcaagtagggctaattatcagtaacaaatagatgggggtgtttgctctgtgtgtgtgtgtgtgtgtgtgtgtgtgtgtgtatatgtgtgtgtttgtgtgaagtgaagtgttgctgctgtaagtagtgtccataagcccatttgactgtattacaagttagttaattactcatatagttggccacatattatgggatctatgttttctgaaaataattggttaatggaagttatctaatatattttaactgttcctgttaaaaacaataggcttcaagatgacataacaccaaatcaaaaatgaccaaaggaatcattttgtttgttagatttgtaatttagcatcattggcaataaatctactcaaacgtt

SEQ ID NO: 348079 - DNA, 1949 bp, Homo sapiens
ttttttgataggaacaaaatgtttattttcttaatggtgaaactttgctttgtatgaaattcacattgaattatgaaagtgtacaataattgggacttcccttacatatttacaggtaaatctacttatacacattagtttaggcaacctttaattatttagagctaaaaaaaaaaccactttttttctaaaggtgaattactttgtaaaatcctagaataatgtagcaaaatcatttccgtattactttaagatgaaaatttttacttggaaattttattttaatgatgtaaatattctagtcatggcttaaactttataagtcaaatttccaaaaataaggaaaatatgcatccactgagttacttaaaaatttaatattgaaaattattttaagagaacatttaactgatcctgatttttatagtactaacaatgttctcataatgtaatagatttataaaaattgttatctctatcctgagattaaggagtgcaaccatgttgtagttctattattgagtacgtaaattgatagatctcttccgtaaaatgagggaaatataagtagtcaataaataatgtaggttatattctttcctcttcactacctaaacattttaagctgtgaacaacctattattattgttttgtagcaattttgatgacgtattcgctgatgcacagacattggaattcattacattatctagccatcgtaatacaaatgacctttggatttctctatcacggcgcttatcctcctattaaggatcagaaagttaaactttacggaccacgtacgtccctgtctcatattcttctttgttggtttctgtttaatactttaaagctgtaaaaaaaatttaaaaaattccttctgagctcccaggccatacaaaagcaacttaagggtggatttggctggcagctgggcagtactttgtcagcctcagctccactggaactgcccttgattctctatagctcatcacaaaacctcaggtatgtcttatttttcttataatcctctgtatgttattatcctttttattaacaacaacaactacaacaaaagtgctgctctttttcatagtctcatgtaagaagagtgtcaaaaatgtcctcggcatttgttttctcagaaaaagaatttagatattggagaaattatcataccataaaaagttcaaaatgtgattcatctaaaattttggacaaagatgaaaatatagtcagctctgttctagtgttcatttagttagaaaccatagtaccggaactgtattatagtagaagttaatggtacctaaactctaaggaatgctttttctttgaaaacagaaatatttttacttatttctgtccactatgtttgtgtgtatgtgtgtgtttgtgtgtgtatgtgtggttttgatgccagcaatgcaaacaccaatatatctattaagaagtgattgaatttagattggaaaaaataaaatagttacatgtaaagacataaactctttccttcttaaatgtgattttcaactctatgatagaaactccctctaaaaaacaagcagggcaagaacaaacttacttgtaatgggtgagagaaaataagcaaatctcattggctcattcctgtttttaggaagttgcagtgggattaatgtcaattggaagggatgcagcaagtttagagaaggtgttggcactaacgctgcttgtttggcaaatcatcatcactgaggtattccacccagagactttttcaaaaaagtcaactaaagtgctaagtcataagaggagagccattatacccgttgtctttctgggctccttgagtttatctggattccaacagcacttggaaagtaccgccctccactacctcaaatgcaaacacaatctctgccagtagacattggaattagacttagtgaaaaccaggaaaaaaaaaa

SEQ ID NO: 348080 - DNA, 2526 bp, Homo sapiens
actctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacatataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgtttaaaaaaaaaaa

SEQ ID NO: 348081 - DNA, 3035 bp, Homo sapiens
actctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagagcaattttgatgacgtattcgctgatgcacagacattggaattcattacattatctagccatcgtaatacaaatgacctttggatttctctatcacggcgcttatcctcctattaaggatcagaaagttaaactttacggaccacgtacgtccctgtctcatattcttctttgttggtttctgtttaatactttaaagctgtaaaaaaaatttaaaaaattccttctgagctcccaggccatacaaaagcaacttaagggtggatttggctggcagctgggcagtactttgtcagcctcagctccactggaactgcccttgattctctatagctcatcacaaaacctcaggtatgtcttatttttcttataatcctctgtatgttattatcctttttattaacaacaacaactacaacaaaagtgctgctctttttcatagtctcatgtaagaagagtgtcaaaaatgtcctcggcatttgttttctcagaaaaagaatttagatattggagaaattatcataccataaaaagttcaaaatgtgattcatctaaaattttggacaaagatgaaaatatagtcagctctgttctagtgttcatttagttagaaaccatagtaccggaactgtattatagtagaagttaatggtacctaaactctaaggaatgctttttctttgaaaacagaaatatttttacttatttctgtccactatgtttgtgtgtatgtgtgtgtttgtgtgtgtatgtgtggttttgatgccagcaatgcaaacaccaatatatctattaagaagtgattgaatttagattggaaaaaataaaatagttacatgtaaagacataaactctttccttcttaaatgtgattttcaactctatgatagaaactccctctaaaaaacaagcagggcaagaacaaacttacttgtaatgggtgagagaaaataagcaaatctcattggctcattcctgtttttaggaagttgcagtgggattaatgtcaattggaagggatgcagcaagtttagagaaggtgttggcactaacgctgcttgtttggcaaatcatcatcactgaggtattccacccagagactttttcaaaaaagtcaactaaagtgctaagtcataagaggagagccattatacccgttgtctttctgggctccttgagtttatctggattccaacagcacttggaaagtaccgccctccactacctcaaatgcaaacacaatctctgccagtagacattggaattagacttagtgaaaaccaggaaaaaaaaaa

SEQ ID NO: 348082 - DNA, 3088 bp, Homo sapiens
tttgatatgcctgcattttggaaaaaaaaattgaggatttagcccagtcgctttcccttgatatagccttgttctgaattaaaatggaaaaaatatttcaattattttcatcttgttctcaactggatgttagtcaatgtggtctctttttgaatatgtatcaaatattaatgatccataatattagggagataattttaaatgaagtgatacgtgtctaacttacttaaagaataagtttttggtttttgcttttaaagacaaccaaatctgatattgttcatcctgataaaaataacaacttttagtgcttaaagcattaattaagcaagtggctaggtatgataaagaacttctgcttgctccccaagaggcaaactattagaagaactggagcgggagtcctttggacccatcgtggatctctttaagccactgctacccaaaaacattcaggacaagcaaacatttagagcaagaatctccaaattcttcaggatttgtaatgaaatgatgttcagttccattttgctctttacatagggtggagaattgtcatgtcttctctaatttttccaagtaaagtggtagcaaaatgttttaaaaagcaatcttatattagaaaacaaaaatgttgtcacttgaaataccaaaacaacatttctgagcgttgttgagggactggcaaagcaatcagctactataacaaatcagtagaaataaccctcccacaccagatatgcatgcagaaggaatggagtattatagagacttgatacaatggacatatgcacatggaggtacaaaacacacagtctaaatacaaatgaattccatcagatttactatacggaacatcagtagtgacagattgcacttcttacttaataacagcaaacttaatttctgaggggaaaaaaatggcgaagtcttatcccaaacaaatagcaagagaggtatcatcaaagagctaaaattttctttggcatggtaaagggggaaattgagtttaccaacttatttacatgacatttctctatattggtgagtaatgcaatgccattttgttacataaagttgtttgatgttttttaatatgccttcatataaatattttattcaatatgttgtatttgtgaatttaacaaatgatattaaacacaaactacaatgcagacagacaaactctttgtatgcaaattagcaatacataccaacagttcttgatacacaggtacctactacatgcagctcatcattgctgtcctcttcccatgctacaggtgagaccagacacaaagtaaatgacctaactcaattacaaataacaaggacccctctgcaatatgtctaaacatatattagaagaaagtatttgacatccttcatagggataaatgcccttatagacaccccatatataaaacacaacagagatacacatttacataaatctcagtcatttacaaaaataaatcttgtcttaatttaaaccaataaacagacttgcaggggaaaaagaaaccagcaagtagggctaattatcagtaacaaatagatgggggtgtttgctctgtgtgtgtgtgtgtgtgtgtgtgtgtgtgtgtatatgtgtgtgtttgtgtgaagtgaagtgttgctgctgtaagtagtgtccataagcccatttgactgtattacaagttagttaattactcatatagttggccacatattatgggatctatgttttctgaaaataattggttaatggaagttatctaatatattttaactgttcctgttaaaaacaataggcttcaagatgacataacaccaaatcaaaaatgaccaaaggaatcattttgtttgttagatttgtaatttagcatcattggcaataaatctactcaaacgttctgctaactttttatttattcaagtagaatccaatatgaaaatgaaataagcataaacaaacagttaaatttctactaaacctttaatcagctaagcaggccagaattttttaatgctgggcaagggctgtcatgaagaagatttatgaaagcagtgacaaaataatttcccaataaatacagtgcagatggggaaaatgatgactgggtcatcctcccacatagaaagaataacaagaggccagtacattgatcccacatataattttcaataaatgaggttcagtttggtctcaatgaactcttctgagaagaaaacattgaattttattaggtgtacacagagttaacaaatatattcccaaacagtttagtatgaaacattttgaacccctttagatccaatattgaacattttgcatggaatcttcattgtgtagtcaactgttcctggcctttcttggtagttgtcttccctaagctcaaacaaacagtgttaaactaaaaaggaaattaagaatgcaaaataaaagaaaataaatggaatggaccaaaatcctcatggatgaatgtgttggtttgcctttattttcatctaggataattcaacagactgtattctgagatcatggcaaggcacctctaacccagccactgggcaacatgagccccagatgctgagctagaggcatgtactggtgaaatacacagtaccggactcagcatgctgagctaaaaaaaatatttttcctaatatgtccagtttaaaaacttgtcattaaacaccaaaaatattaaagtctaattaatttataactaacgtttgcattgctgctgcaggaaagaacacaacagccgtcttgcccatgctctgctgagtatgaggggaacgcagccagaaacggggatggcgttaagtttggttcattaaaaacaggacggagtatatctgaaatggatttagacgcacttgtgcttttacttggcgtcaccccaggcttcgggaccgtttccccaacatcatgcaaagatggttctcggtacatggcaactagtgatgggaagaaaggaggaggaaaagcaaacattgcttggttaggtgtgagaatggtccatccatacctgcatagaccactgcagtttgcccatttctgttttccctgaagtaaagcaattccattgagacagaa

SEQ ID NO: 348083 - DNA, 1621 bp, Homo sapiens
actctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggtagtaacctttctcatagctgtatgctacctgcatgcaacttgctttacctgcctttgttattctactgactcttgctttttcaattgctgttaaaaataagataaacagaaagcaatataccattgaacctaaaagcaatatacaattaggtttgtaatgacttttatttccctgaactctttatttagcaggtatgtgaaagtacgcagtacactatcaataaaagatcattgaatctaaactaa

SEQ ID NO: 348084 - DNA, 2459 bp, Homo sapiens
actctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggatgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacatataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgtttaaaaaaaaaaa

SEQ ID NO: 348085 - DNA, 2236 bp, Homo sapiens
actctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagagcaattttgatgacgtattcgctgatgcacagacattggaattcattacattatctagccatcgtaatacaaatgacctttggatttctctatcacggcgcttatcctcctattaaggatcagaaagttaaactttacggaccacgaaagaacacaacagccgtcttgcccatgctctgctgagtatgaggggaacgcagccagaaacggggatggcgttaagtttggttcattaaaaacaggacggagtatatctgaaatggatttagacgcacttgtgcttttacttggcgtcaccccaggcttcgggaccgtttccccaacatcatgcaaagatggttctcggtacatggcaactagtgatgggaagaaaggaggaggaaaagcaaacattgcttggttaggtgtgagaatggtccatccatacctgcatagaccactgcagtttgcccatttctgttttccctgaagtaaagcaattccattgagacagaa

SEQ ID NO: 348086 - DNA, 777 bp, Homo sapiens
tctacacggacttaatacacctaccgcaattctatgcacctgtctttcaaattctataaaatatttgttgacactttccctttcacttgttttttacaatatattttgtacaaaaatttgtcaaacattgaaaagaaacatagtcctcatcaaaatgtcttagctttcccttcagagcatttctttcagcctgcttcacggtgatattcttgctttgacagcggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgccacacacgagttaccacggaccactccactgggggttctggaggacaggaagggtgacccacagaggattataccaccggggtgtgccaccgccg

SEQ ID NO: 348087 - DNA, 1341 bp, Homo sapiens
agggagagaggggaagaaggggagagtaggagcgggggcgaaggagggaggagggcaagatggagcgcggaaaaggcggagaaaagggacgagggagagcgggcagaaggcaaagacagaagggagcgagggagggagttcctcgggcctggcccctttactaggtcagtctggcaggtacctcgccggcccaggacggggctggccaaacctcaccgcttgctcccgggctggcttccagaccaagggcacgcagaggtcggagcctgcccagaagccacacctggccagaaaaaccgaaggtgtatcaaggtgtccgagtgaagatcacagtgaaggagctgctgcagcaaagacgggcacaccaggcggcctccgggggaacccggtccggaggcagcagtgtccacctttcagacccagttgcaccatcttctgcaggactgtattttgagcctgaaccaatttcttccacgcccaattatttgcaacggggagaattttccagttgtgtttcatgtgaagaaaactcaagctgcctcgaccagatctttgattcctaccttcagacagagatgcacccggagcctttgctcaattccacacaaagtgctccacaccatttcccagacagcttccaggccacccctttctgctttaaccagagcctgatcccaggatcaccttcaaattcctccattctctctggctccttagactacagttactcgccagtgcagctgccttcatatgctccagagaattacaattcccctgcttctctggacaccagaacctgtggctaccccccagaagaccattcctaccaacacttgtcctcacacgcccagtacagctgcttctcctcggccaccacctccatctgctactgcgcatcgtgtgaggcagaggacttggatgctctccaggcagcagagtacttctacccgagcacagactgtgtggactttgccccctcagcagccgccaccagtgatttctataagagggaaacaaactgtgacatctgctatagttaatagaaattacagtaattcagaacatggcatgggtatatctatttttctaccacgtctagatgacactgcaaaatatgcaacttggtaacacaatatcccaagcacagtttacatgtcactatttccaattttctgatgctaagcattcatatgaagtcctcagacccggtcacagcgccactcctactttgtatgctcatagtttaaatttttgtaggaaactttcaattgttttactttttgtataacgaacaaatgctgtctccttttttactaataaataattttgtattactaaaaa

SEQ ID NO: 348088 - DNA, 1388 bp, Homo sapiens
aagcagaatggctggaggaagagccctgtgggggagtggaatttcagttgctaaaattaggagcaggggaaggaggtggaaagagcaaaattatgtaacatgggttgtctgttcttgggcaactggagctccacacccaaagccagccaggctgctggctccatccatctctgccctctagcttgtcagttgtatctctcttcctccagggccccaatcctcatctccgccattcagctgctgccccatcctaaacctgagttcatctctgggcagcccaggcatggccttccctataaacatttccttttccaagaaccagtagttgaagtcctgagaggtggagggagagtctgggattcccacggaggagagaggggggctccctggaaactaagataggtagaccccactaccatcgcccaggacacaactgggaacttggcaaaaagaaaggacagggctgcaaggagagtacagacatgtgctggtgagtgcactgtctgcatagttacaccagagcatcttatcaatcagaaacttatctttcaggttttgagcccagttctctacaggagaatcccaggagtggaagtggaaggcagtagaagacagggagggcacgcctctgggaacacgggaacatgggtgggcatgagatccttgaataagacagcctgaagttcggaagagaccaaggcctctgaaggaccaggcagatgttcagggtgcaggagggggaagggctggtgagaaagatcctgtgagaggaagctgctgtgattcagagaagagacttcaagctgtgtgtgaccctggcgtccggttcctctcacaggctggagcttttcggaagtggcatgcaaagagtccaggtttggccttggggggagttggggttaggatccctaagctggaggttgagaagtaaattacagaaaactctggtgaccaaatttgctcctccacccaggagatttctcactggtttttaagcacatcatttccccttctgcaagagttacataaaaccaaagcaaaataagccctgaaacctgggcccaccggaccacagtcttttcaacgtcccttcctggtgtctggcccccagccctggtgggggttcccctgagataagggctgttcactttctctgaccacatggtttccgcttctgtgtctcttgtttcctaggctgataaaaatactgagccctagaggccctggcttcctctgaccccttggggcaggcagcaggcatcctgtccagcatggtgggggcagggacaggggccagggattcccaaggggtgactcagtgcctgccatgaaacagtgggtaggtggaagtgtatctctgctctctagagctggcaccaggagttgag

SEQ ID NO: 348089 - DNA, 752 bp, Homo sapiens
tctctgctcgccctcagtcccacccggtgcctacggggccgcatcgccgcccggctcggcccggcccatgcccagggccgctgctccctcagttgccgccgccgccgccggcgcccagggggccgccgcggctgtgaggtgggggcggcagcgggaggcggcggggcgggccgccggggccggggctgggggcgcagcgcggccggcgtaggtctatgtcgcgggcggcggcggcggcggcggccgcggagggacgatgcgcgagtacaaagtggtggtgctgggctcgggcggggtaggcaaatccgccctgaccgtgcagttcgtgaccggcaccttcatcgagaaatacgaccccaccatcgaggacttctaccgcaaggagatcgaggtggattcgtcgccgtcggtgctggagatcctggacacggcgggcaccgagcagttcgcgtccatgcgggacctgtacatcaagaacggccagggcttcatcctcgtctacagcctcgtcaaccagcagagcttccaggacatcaagcccatgcgggaccagatcatccgcgtgaagcggtgagcgagggcacacgggggcttggcggctgcaccccggagtcaccgtcccggggccggaactccccgcgcggggctccggggaaggggctttctggggggtggctccaagctggaggctttactattgtcattctgctcctcctcctcaatctcaaatttgagtgctttgtttcacaact

SEQ ID NO: 348090 - DNA, 4367 bp, Homo sapiens
tctctgctcgccctcagtcccacccggtgcctacggggccgcatcgccgcccggctcggcccggcccatgcccagggccgctgctccctcagttgccgccgccgccgccggcgcccagggggccgccgcggctgtgaggtgggggcggcagcgggaggcggcggggcgggccgccggggccggggctgggggcgcagcgcggccggcgtaggtctatgtcgcgggcggcggcggcggcggcggccgcggagggacgatgcgcgagtacaaagtggtggtgctgggctcgggcggggtaggcaaatccgccctgaccgtgcagttcgtgaccggcaccttcatcgagaaatacgaccccaccatcgaggacttctaccgcaaggagatcgaggtggattcgtcgccgtcggtgctggagatcctggacacggcgggcaccgagcagttcgcgtccatgcgggacctgtacatcaagaacggccagggcttcatcctcgtctacagcctcgtcaaccagcagagcttccaggacatcaagcccatgcgggaccagatcatccgcgtgaagcggtatgagaaagtgccagtcatcttggttgggaacaaagtggacctggaaagtgagagagaagtatcgtccagcgaaggcagagcccttgctgaagagtggggctgcccctttatggaaacttccgctaagagtaaaacaatggtggacgaactctttgcagaaattgtgaggcagatgaactatgctgctcagcctgacaaagatgacccatgctgttctgcatgtaacatacaatagcatccaaatatggctgtcctggatgggatttgcccaatgtcgtaggtgatagaaaactcgcctactccactgcagaacttgcagaatgcgtggtgttaatctacagagaactgcagcccttattcagaattgagcagtgattgtcagttgatatctctgagtaacatttgggttcagtaactacagttttcaccatttgtcctcagtctcctttatgcatctgcaactttaaggcatagtccatcgatctacagggtgatctcatttgaaagctatgatggcattgtcgctgagttgacagaagcaactattgtacaaattaaaaataaccataagggagaaaccagaagaattcctctgaccacttacaattaaaatattttgtcttctttaaaaaaataagtaaaggagaaatattttcctacaagagtactgaatttcaggaaatgggatagagcttctaaccagtgtattccgtcaagtaagataataacagctgacctgccaacagcattacagggagattctttgctcagctaacacatttctgtttttcaaaattgatgcttaattgtagctgttattctaatttgtgacatggaactaactcatgcttcaatccttgatagagcaaaactcagaacaggttatgtaaaaatatagtctggctttagaatttgttaattcacctgctttgccacagaaaatggaggctttcacaagggtttgatcagaattaaaaccccaaacccgccctctgttaggggtggtctttataactttactgaacaagagggaagcaactgtgatgggaagagattacctagccttactaacaagaagcattctaatagataaactagtaccatcatgtaaggaagatgaagccatgttgcatccacatgttcccgtttgcagaaacctcacaggacagtacgaatatctggcatttttaagttcattaaagcagcaaattccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctttagctcttgtgataagattttcttttttttacttttatacaaaggcagcatctttgaatttttttttcttttgatgttgcaacttttgggttcttttaaactgtgatagtgatggtaactgatgcctttcattttgttcaacttatacaaaacaagccagcatctgatcaaaagtattacataaaatattttcttaaactattgaaaggtgctttgatgattttctcctttggtttgtagaattaggactgaacttttgactcaaattgctacagttgccatcacctttctgtggtaatactactgatatttgcttttctatataaagaaatgttgcctaaggctgtctggtatttcttttcaagggttttccagtatgaatgttaatgttgtcagtgtatgtatgaatatgaaagtgctttgttttgtttgttgctgttttttgtttatgtgtgtgtttttaatttttttgttcttatcagcagtcttgtgttagcactgggtaagctttaattgtcccttagccaatcaaacattaaggactatggaggtcttttttttttttatttaacatgtcattgttcatctattaaatcttgatcagggtttcaagaatgactgcagtgggttttggaaacagacttatcattattgatttgaggtttcccagagatatagttcacagttaattgttgcgctctaatacaactgaccatttaaaattgaacaagtttattgttttgtaacaatgtcagttgttaaaccttgacatttcaattaaaacatgaattgtagttataactcaatgcaaattcaacagttgtatttggagttaaattattttaacaaataaatttatttaatgaaaaaaaaaaat

SEQ ID NO: 348091 - DNA, 3920 bp, Homo sapiens
tctctgctcgccctcagtcccacccggtgcctacggggccgcatcgccgcccggctcggcccggcccatgcccagggccgctgctccctcagttgccgccgccgccgccggcgcccagggggccgccgcggctgtgaggtgggggcggcagcgggaggcggcggggcgggccgccggggccggggctgggggcgcagcgcggccggcgtaggtctatgtcgcgggcggcggcggcggcggcggccgcggagggacgatgcgcgagtacaaagtggtggtgctgggctcgggcggggtaggcaaatccgccctgaccgtgcagttcgtgaccggcaccttcatcgagaaatacgaccccaccatcgaggacttctaccgcaaggagatcgaggtggattcgtcgccgtcggtgctggagatcctggacacggcgggcaccgagcagttcgcgtccatgcgggacctgtacatcaagaacggccagggcttcatcctcgtctacagcctcgtcaaccagcagagcttccaggacatcaagcccatgcgggaccagatcatccgcgtgaagcggtatgagaaagtgccagtcatcttggttgggaacaaagtggacctggaaagtgagagagaagtatcgtccagcgaaggcagagcccttgctgaagagtggggctgcccctttatggaaacttccgctaagagtaaaacaatggtggacgaactctttgcagaaattgtgaggcagatgaactatgctgctcagcctgacaaagatgacccatgctgttctgcatgtaacatacaatagcatccaaatatggctgtcctggatgggatttgcccaatgtcgtaggtgatagaaaactcgcctactccactgcagaacttgcagaatgcgtggtgttaatctacagagaactgcagcccttattcagaattgagcagtgattgtcagttgatatctctgagtaacatttgggttcagtaactacagttttcaccatttgtcctcagtctcctttatgcatctgcaactttaaggcatagtccatcgatctacagggtgatctcatttgaaagctatgatggcattgtcgctgagttgacagaagcaactattgtacaaattaaaaataaccataagggagaaaccagaagaattcctctgaccacttacaattaaaatattttgtcttctttaaaaaaataagtaaaggagaaatattttcctacaagagtactgaatttcaggaaatgggatagagcttctaaccagtgtattccgtcaagtaagataataacagctgacctgccaacagcattacagggagattctttgctcagctaacacatttctgtttttcaaaattgatgcttaattgtagctgttattctaatttgtgacatggaactaactcatgcttcaatccttgatagagcaaaactcagaacaggttatgtaaaaatatagtctggctttagaatttgttaattcacctgctttgccacagaaaatggaggctttcacaagggtttgatcagaattaaaaccccaaacccgccctctgttaggggtggtctttataactttactgaacaagagggaagcaactgtgatgggaagagattacctagccttactaacaagaagcattctaatagataaactagtaccatcatgtaaggaagatgaagccatgttgcatccacatgttcccgtttgcagaaacctcacaggacagtacgaatatctggcatttttaagttcattaaagcagcaaattccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctttagctcttgtgataagattttcttttttttacttttatacaaaggcagcatctttgaatttttttttcttttgatgttgcaacttttgggttcttttaaactgtgatagtgatggtaactgatgcctttcattttgttcaacttatacaaaacaagccagcatctgatcaaaagtattacataaaatattttcttaaactattgaaaggtgctttgatgattttctcctttggtttgtagaattaggactgaacttttgactcaaattgctacagttgccatcacctttctgtggtaatactactgatatttgcttttctatataaagaaatgttgcctaaggctgtctggtatttcttttcaagggttttccagtatgaatgttaatgcatcacacatgtatttttatcctctagagtcagctatagcg

SEQ ID NO: 348092 - DNA, 2783 bp, Homo sapiens
  misc_feature (16)..(16): n is a, c, g, or t
  misc_feature (34)..(35): n is a, c, g, or t
  misc_feature (41)..(41): n is a, c, g, or t
tgggaggtggttgttnaggtatcctcactttganncccttnctacgagaccatagagtgttgctacccggtatttcggccattatggccggggcatgtaaggaagatgaagccatgttgcatccacatgttcccgtttgcagaaacctcacaggacagtacgaatatctggcatttttaagttcattaaagcagcaaattccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctttagctcttgtgataagattttcttttttttacttttatacaaaggcagcatctttgaatttttttttcttttgatgttgcaacttttgggttcttttaaactgtgatagtgatggtaactgatgcctttcattttgttcaacttatacaaaacaagccagcatctgatcaaaagtattacataaaatattttcttaaactattgaaaggtgctttgatgattttctcctttggtttgtagaattaggactgaacttttgactcaaattgctacagttgccatcacctttctgtggtaatactactgatatttgcttttctatataaagaaatgttgcctaaggctgtctggtatttcttttcaagggttttccagtatgaatgttaatgttgtcagtgtatgtatgaatatgaaagtgctttgttttgtttgttgctgttttttgtttatgtgtgtgtttttaatttttttgttcttatcagcagtcttgtgttagcactgggtaagctttaattgtcccttagccaatcaaacattaaggactatggaggtcttttttttttttatttaacatgtcattgttcatctattaaatcttgatcagggtttcaagaatgactgcagtgggttttggaaacagacttatcattattgatttgaggtttcccagagatatagttcacagttaattgttgcgctctaatacaactgaccatttaaaattgaacaagtttattgttttgtaacaatgtcagttgttaaaccttgacatttcaattaaaacatgaattgtagttataactcaatgcaaattcaacagttgtatttggagttaaattattttaacaaataaatttatttaatgaaaaaaaaaaat

SEQ ID NO: 348093 - DNA, 663 bp, Homo sapiens
cccgggcaaaacacgcaaccaggaccgggatcgaggccattccgttagtcaaaccactaagccagggcggaagaccccttcaagcacgcgcatcatggtgggcattacccgcaaaagatgccattaatggggtgcaaacatgccggaacgggctcctgggatgccaatgccccgcccatgctcagcagcagcaacagcagcagcccctggagctcgtgccgaattcggcacgagttgtcagtgtatgtatgaatatgaaagtgctttgttttgtttgttgctgttttttgtttatgtgtgtgtttttaatttttttgttcttatcagcagtcttgtgttagcactggttttatttaacatgtcattgttcatctattaaatcttgatcagggtttcaagaatgactgcagtgggttttggaaacagacttatcattattgatttgaggtttcccagagatatagttcacagttaattgttgcgctctaatacaactgaccatttaaaattgaacaagtttattgttttgtaacaatgtcagttgttaaaccttgacatttcaattaaaacatgaattgtagttataactcaatgcaaattcaacagttgtatttggagttaaattattttaacaaataaatttatttaatgaaaaaaaaaaat

SEQ ID NO: 348094 - DNA, 4336 bp, Homo sapiens
tctctgctcgccctcagtcccacccggtgcctacggggccgcatcgccgcccggctcggcccggcccatgcccagggccgctgctccctcagttgccgccgccgccgccggcgcccagggggccgccgcggctgtgaggtgggggcggcagcgggaggcggcggggcgggccgccggggccggggctgggggcgcagcgcggccggcgtaggtctatgtcgcgggcggcggcggcggcggcggccgcggagggacgatgcgcgagtacaaagtggtggtgctgggctcgggcggggtaggcaaatccgccctgaccgtgcagttcgtgaccggcaccttcatcgagaaatacgaccccaccatcgaggacttctaccgcaaggagatcgaggtggattcgtcgccgtcggtgctggagatcctggacacggcgggcaccgagcagttcgcgtccatgcgggacctgtacatcaagaacggccagggcttcatcctcgtctacagcctcgtcaaccagcagagcttccaggacatcaagcccatgcgggaccagatcatccgcgtgaagcggtatgagaaagtgccagtcatcttggttgggaacaaagtggacctggaaagtgagagagaagtatcgtccagcgaaggcagagcccttgctgaagagtggggctgcccctttatggaaacttccgctaagagtaaaacaatggtggacgaactctttgcagaaattgtgaggcagatgaactatgctgctcagcctgacaaagatgacccatgctgttctgcatgtaacatacaatagcatccaaatatggctgtcctggatgggatttgcccaatgtcgtaggtgatagaaaactcgcctactccactgcagaacttgcagaatgcgtggtgttaatctacagagaactgcagcccttattcagaattgagcagtgattgtcagttgatatctctgagtaacatttgggttcagtaactacagttttcaccatttgtcctcagtctcctttatgcatctgcaactttaaggcatagtccatcgatctacagggtgatctcatttgaaagctatgatggcattgtcgctgagttgacagaagcaactattgtacaaattaaaaataaccataagggagaaaccagaagaattcctctgaccacttacaattaaaatattttgtcttctttaaaaaaataagtaaaggagaaatattttcctacaagagtactgaatttcaggaaatgggatagagcttctaaccagtgtattccgtcaagtaagataataacagctgacctgccaacagcattacagggagattctttgctcagctaacacatttctgtttttcaaaattgatgcttaattgtagctgttattctaatttgtgacatggaactaactcatgcttcaatccttgatagagcaaaactcagaacaggttatgtaaaaatatagtctggctttagaatttgttaattcacctgctttgccacagaaaatggaggctttcacaagggtttgatcagaattaaaaccccaaacccgccctctgttaggggtggtctttataactttactgaacaagagggaagcaactgtgatgggaagagattacctagccttactaacaagaagcattctaatagataaactagtaccatcatgtaaggaagatgaagccatgttgcatccacatgttcccgtttgcagaaacctcacaggacagtacgaatatctggcatttttaagttcattaaagcagcaaattccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctttagctcttgtgataagattttcttttttttacttttatacaaaggcagcatctttgaatttttttttcttttgatgttgcaacttttgggttcttttaaactgtgatagtgatggtaactgatgcctttcattttgttcaacttatacaaaacaagccagcatctgatcaaaagtattacataaaatattttcttaaactattgaaaggtgctttgatgattttctcctttggtttgtagaattaggactgaacttttgactcaaattgctacagttgccatcacctttctgtggtaatactactgatatttgcttttctatataaagaaatgttgcctaaggctgtctggtatttcttttcaagggttttccagtatgaatgttaatgttgtcagtgtatgtatgaatatgaaagtgctttgttttgtttgttgctgttttttgtttatgtgtgtgtttttaatttttttgttcttatcagcagtcttgtgttagcactgggtaagctttaattgtcccttagccaatcaaacattaaggactatggaggtcttttttttttttatttaacatgtcattgttcatctattaaatcttgatcagggtttcaagaatgactgcagtgggttttggaaacagacttatcattattgatttgaggtttcccagagatatagttcacagttaattgttgcgctctaatacaactgaccatttaaaattgaacaagtttattgttttgtaacaatgtcagttgttaaaccttgacatttcaattaaaacatgaattgtagttataactcaatgcaaattcaacagttgtatttggagttaaattattttaacaaataaatttatttaatgaaaaaaaaaaat

SEQ ID NO: 348095 - DNA, 3561 bp, Homo sapiens
tctctgctcgccctcagtcccacccggtgcctacggggccgcatcgccgcccggctcggcccggcccatgcccagggccgctgctccctcagttgccgccgccgccgccggcgcccagggggccgccgcggctgtgaggtgggggcggcagcgggaggcggcggggcgggccgccggggccggggctgggggcgcagcgcggccggcgtaggtctatgtcgcgggcggcggcggcggcggcggccgcggagggacgatgcgcgagtacaaagtggtggtgctgggctcgggcggggtaggcaaatccgccctgaccgtgcagttcgtgaccggcaccttcatcgagaaatacgaccccaccatcgaggacttctaccgcaaggagatcgaggtggattcgtcgccgtcggtgctggagatcctggacacggcgggcaccgagcagttcgcgtccatgcgggacctgtacatcaagaacggccagggcttcatcctcgtctacagcctcgtcaaccagcagagcttccaggacatcaagcccatgcgggaccagatcatccgcgtgaagcggtatgagaaagtgccagtcatcttggttgggaacaaagtggacctggaaagtgagagagaagtatcgtccagcgaaggcagagcccttgctgaagagtggggctgcccctttatggaaacttccgctaagagtaaaacaatggtggacgaactctttgcagaaattgtgaggcagatgaactatgctgctcagcctgacaaagatgacccatgctgttctgcatgtaacatacaatagcatccaaatatggctgtcctggatgggatttgcccaatgtcgtaggtgatagaaaactcgcctactccactgcagaacttgcagaatgcgtggtgttaatctacagagaactgcagcccttattcagaattgagcagtgattgtcagttgatatctctgagtaacatttgggttcagtaactacagttttcaccatttgtcctcagtctcctttatgcatctgcaactttaaggcatagtccatcgatctacagggtgatctcatttgaaagctatgatggcattgtcgctgagttgacagaagcaactattgtacaaattaaaaataaccataagggagaaaccagaagaattcctctgaccacttacaattaaaatattttgtcttctttaaaaaaataagtaaaggagaaatattttcctacaagagtactgaatttcaggaaatgggatagagcttctaaccagtgtattccgtcaagtaagataataacagctgacctgccaacagcattacagggagattctttgctcagctaacacatttctgtttttcaaaattgatgcttaattgtagctgttattctaatttgtgacatggaactaactcatgcttcaatccttgatagagcaaaactcagaacaggttatgtaaaaatatagtctggctttagaatttgttaattcacctgctttgccacagaaaatggaggctttcacaagggtttgatcagaattaaaaccccaaacccgccctctgttaggggtggtctttataactttactgaacaagagggaagcaactgtgatgggaagagattacctagccttactaacaagaagcattctaatagataaactagtaccatcatgtaaggaagatgaagccatgttgcatccacatgttcccgtttgcagaaacctcacaggacagtacgaatatctggcatttttaagttcattaaagcagcaaattccttctcgcctttaagggctatggttgtagtgtgacccgtggctaacctgctttcaaaatcaagtatttgctgtagcagagctttattgcaggcattttaaaaattgaataaccatgtgaaataatttgggcttaaaagtgaacataaattatagagtggaaggtaagggacaaaagccttttacctttaattttcctggagaattatataaaggttttcttagaacaattttgccctgattactgaagcgtcaaataaagctggagtgaaaattttgttttgaaaaggtgctcaagctctgacatttttggttttcatagtcgtgaagtatttatcatttgcatgactaatggcacaggaaaaacctattcataagttttacaatcaagtatagaggggtcttcagctaacttagttatacataaatgctgaaaagattatcttgagctgggccttgggagaagaatttggccttcagaactgcaatatcactgagcctgcgatctatacaccaccccacattttgttggtttcacagtcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaaaaaaaaaaagattgatagtatttttcataatgaaaaaactgaagagatacgtgaatgaaaccaggccatagctgtcataaatctttgacttttgaatatttacattcttcagtataattttttataatcctcaattatgaaccaccttgtttataggacaaaaaaatttaaccaattttattgaaacgaatttcactgtgtaaaagttggtttgattcaaacatgtagagaagttgtagattcaagatatatgatttctctatggaaataaaaatatttgttagtgaattggttgagttttgattcctctaacttctcagaatgattctttagaattctataattcatagcaatttttgacaagtaagattgcaaaatagaaatatctataaagattccacagtttgacattatggcttgctatgcagatgtgaaaataggttaaataatatgaaagatatggcagaatgtaaagtggaaaagatgacctaaaattttgagttgtattaatagttaaaaacatttgtgtcagatgacagggtgggcttttactgtcaagacatgaataagaactgatctggctgcctgatgagtgtttccacgcagccctgcatatttagtgaccaaggcatcaaggacatcccgaaactggaaattcatatccatctggtatgaatatataactcagctggcaaatgaatgtgtttgttgagatattacagtaataaaacacttaagaacaggaagattacatttgttggcatacgaaaccttagtggctacagaagaaagttgaccttgtgtcactatttattttatgccctgatcagactagcaacttagataagtgaaagtttttctaacatgccttaaaaatattatggtttgatccaaagacccactttttctaagagctttgctttcttttctttttgtttcttttttcttttttttattttttggaaagggagttcccccttt

SEQ ID NO: 348096 - DNA, 1115 bp, Homo sapiens
agttaaaacctaaatgagcaacaaacgaggtgacgtgcgttatcagttttgtcttccatgtcttcctcatcctgctgtttgctccacggctcttgacaggatggagacgaggaaagaacttccacatccacattcaaaacgtctgccagaactccctcaggcgattactttaaaacatgaaagaaattgcaccttttccttaagggcaagatggtgctgtgggctttcctctctcctgatgagatgatgcaaatggactccatagagaaacgctgcccgtgtaacaatgcagttacgcaacccggtgcatgacacatgaattgcagcgcacctgagatcctgatgaaatcctgggagcctggagctgtcaaacatggttttaaaaaataaagggaatacacccagcccacaccctgactttacaacctttaattaattagaggaaagaaagagagatttgtctggtttcatgacttcaactttccacctggaatatgaagctcctgctcttcccacctccttttcttctctctctctctctcaggtttttaaatttctatttccagttctgccaccaaaaatagattgcaaatatattctgcataattccgaggctacactataaatgttggagtgctactacttgtataatagtcacaaatgaacgcacgagtgggcacagaccgccactctgcctccctcctgctcctgcaccagccaatagtgtctgaagtcagacccatcccatcttcctgtccagctgtttagtctcaaattgtacatttatttcattaatagatcagtctaagatgttcatctcatgtaacaaaggggcatctttttttcttgggagcctggctggtttgttggtggaaaggcagggctcaggggccgtcgatgtttaacttaagcctcctgtactttcacattctgggacccagcaccttcttgtctatagttagctttttgaaaagtgctatttgattacaatttaaggctgggcgccgtggctcacgcctgtaatcccagcactttgggaggccaaggcaggcggatcacctgaggtagggaattcgagaccaacctgaccaatatggagaaacccccatctctac

SEQ ID NO: 348097 - DNA, 533 bp, Homo sapiens
atgtgggtgcatggtgcgtgtgttcctgtttgtgtctatgcatgtgtgtgtgtgcatgtgtcttttgtaagtacaggaagaagtcaggagtcgtcatggtagtgaggatagcagtactgtgtcctatcagggccagacacggcacctttcagatactgtagtcatgcacttaatcctcaactgggttaccactgttatctccaattcacagatcaggaaactgaggcaagcgaccaacctaagttgaattctgaagtcaggcaacttgtgtccaaagtccatgaccagaatctttctgttttgccgccatgctcaaaataggaaaggcggcaagatggtgctgtgggctttcctctctcctgatgagatgatgcaaatggactccatagagaaacgctgcccgtgtaacaatgcagttacgcaacccggtgcatgacacatgaattgcagcgcacctgagatcctgatgaaatcctgggagcctggagctgtcaaacatggttttaaaaaataaagggaatacacccagccca

SEQ ID NO: 348098 - DNA, 565 bp, Homo sapiens
cctggatgtactatgtatggtctttcaagtgaaaactgtctacagagcaagagtccagcatccacgtgcactcctgaccaggacgtagagagaggccctccaggaggtgtgcaaagtggcgtggatttgggacagcgatttgacagtatctgagaaagttaaaactctgcatccccaacacacagcaagccctgcagcgatcaggaaactgaggcaagcgaccaacctaagttgaattctgaagtcaggcaacttgtgtccaaagtccatgaccagaatctttctgttttgccgccatgctcaaaataggaaaggcgcgattactttaaaacatgaaagaaattgcaccttttccttaagggcaagatggtgctgtgggctttcctctctcctgatgagatgatgcaaatggactccatagagaaacgctgcccgtgtaacaatgcagttacgcaacccggtgcatgacacatgaattgcagcgcacctgagatcctgatgaaatcctgggagcctggagctgtcaaacatggttttaaaaaataaagggaatacacccagccca

SEQ ID NO: 348099 - DNA, 354 bp, Homo sapiens
gggggggaaggaggcgcacgacagatggccgtatcgcgcgaaggcagcaccttgaggatttttatgtgtatggtcatttcaagtgaattttgtatacagagcaaggcgattactttaaaacatgaaagaaattgcaccttttccttaagggcaagatggtgctgtgggctttcctctctcctgatgagatgatgcaaatggactccatagagaaacgctgcccgtgtaacaatgcagttacgcaacccggtgcatgacacatgaattgcagcgcacctgagatcctgatgaaatcctgggagcctggagctgtcaaacatggttttaaaaaataaagggaatacacccagccca

SEQ ID NO: 348100 - DNA, 308 bp, Homo sapiens
  misc_feature (1)..(1): n is a, c, g, or t
  misc_feature (40)..(40): n is a, c, g, or t
ntctattaagtaactatgccgcctggccgttttcaggtgnactttgtatacagagcaaggcgattactttaaaacatgaaagaaattgcaccttttccttaagggcaagatggtgctgtgggctttcctctctcctgatgagatgatgcaaatggactccatagagaaacgctgcccgtgtaacaatgcagttacgcaacccggtgcatgacacatgaattgcagcgcacctgagatcctgatgaaatcctgggagcctggagctgtcaaacatggttttaaaaaataaagggaatacacccagccca

SEQ ID NO: 348101 - DNA, 1239 bp, Homo sapiens
atgtgggtgcatggtgcgtgtgttcctgtttgtgtctatgcatgtgtgtgtgtgcatgtgtcttttgtaagtacaggaagaagtcaggagtcgtcatggtagtgaggatagcagtactgtgtcctatcagggccagacacggcacctttcagatactgtagtcatgcacttaatcctcaactgggttaccactgttatctccaattcacagatcaggaaactgaggcaagcgaccaacctaagttgaattctgaagtcaggcaacttgtgtccaaagtccatgaccagaatctttctgttttgccgccatgctcaaaataggaaaggcggcaagatggtgctgtgggctttcctctctcctgatgagatgatgcaaatggactccatagagaaacgctgcccgtgtaacaatgcagttacgcaacccggtgcatgacacatgaattgcagcgcacctgagatcctgatgaaatcctgggagcctggagctgtcaaacatggttttaaaaaataaagggaatacacccagcccacaccctgactttacaacctttaattaattagaggaaagaaagagagatttgtctggtttcatgacttcaactttccacctggaatatgaagctcctgctcttcccacctccttttcttctctctctctctctcaggtttttaaatttctatttccagttctgccaccaaaaatagattgcaaatatattctgcataattccgaggctacactataaatgttggagtgctactacttgtataatagtcacaaatgaacgcacgagtgggcacagaccgccactctgcctccctcctgctcctgcaccagccaatagtgtctgaagtcagacccatcccatcttcctgtccagctgtttagtctcaaattgtacatttatttcattaatagatcagtctaagatgttcatctcatgtaacaaaggggcatctttttttcttgggagcctggctggtttgttggtggaaaggcagggctcaggggccgtcgatgtttaacttaagcctcctgtactttcacattctgggacccagcaccttcttgtctatagttagctttttgaaaagtgctatttgattacaatttaaggctgggcgccgtggctcacgcctgtaatcccagcactttgggaggccaaggcaggcggatcacctgaggtagggaattcgagaccaacctgaccaatatggagaaacccccatctctac

SEQ ID NO: 348102 - DNA, 1280 bp, Homo sapiens
tctagtaagaggttaactattcatgatcactagattattaaaataatcttttttcatgatcactagatcactctgaatccttgtttcagagcaagaacgacatgattcttttgacacagattgagcttttaaagagctcactcaaagggcttttagacgccaatcttctaatcgtttatggcagagttaaggacagcaattgaatgtgattgctactacaaggatttttactttctagaattacttttagttaaaaagttgtggagatttatgctgcatcaccacacttaagatctttgccaatttctggatttatgttaagattcatcagtttatctcaggatatatttttaacacgtgtttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348103 - DNA, 1083 bp, Homo sapiens
ctttccctttttttgtccttgtactacctgccgcgttttccatgcgcttccctctctctgctgtctgtcagacgcccaaactcatgatacatacgagttcgccggccgaccacccggattcgccttacgccggggcaaacgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348104 - DNA, 1557 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactca

SEQ ID NO: 348105 - DNA, 1859 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactcaattcttttgattcagtgctcttgtgtttttaaaaaaaggaacaaaaagtaatgcaagactcaaaattttggagtggttggcgtgcctctcttcattttactttttgactggctgcctgtatgccgatgatgatgtagctgagctgtttgtgctgctgctgctgccatagccatttgatgctgcaagaatcgcaactgcagctgcctgtgactgcataaaacttcctactccagtaaggttaataacagcagcttgctgagcagataaggcctgttcttgactggttgaaccttgctcagaac

SEQ ID NO: 348106 - DNA, 1696 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccagaccaggcatgttcccgccacttcagtcctaaacatatgtagatgaaaactcagtgtgagccttaaattagggagggccaaatagaatatgggatattttatttacctaattttagtatagtttcttagctacctaaaatgttcttccatcttaatggtatatgtcagtggttcttaaacttaagacatacattagaatcacttggaggtcttgtgaaactaacttgtagatcttgagactgtaccctgatttacattatccaatttttttgttttataatttgacatgacattaatgttttttgaaaaggaatgataactgagattaaaagtattggcaaaataatttttcaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348107 - DNA, 1396 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaactaaagggtgcaaacgaaaacatctgtggtctccgtggttgttaaagttgcagaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348108 - DNA, 1300 bp, Homo sapiens
ggagcaggctagggagcacaccccttctgggggctcgagacctccctgggtggagcagaactgcagcggctgcaggtcccggagagtctgggagaggtcgaggttgacagaggaggtgggtagggggcgcgggcgccaggggcgatggaagcggcgatgatgccaggccgggtgggtgcgctccagtgtgaaaaaacttacaagtctctgagcacacaaagagataagattccaagggaaaattaaagaaccgaagaaaaggagagtgaaactccaggaaactccgaggtcaggaatttgggggaatctaggggaaaagggacttctccgagaactggtagcgcggaggaggggacgcctgaggagccgcagtctccaggagagcgaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348109 - DNA, 2849 bp, Homo sapiens
  misc_feature (1185)..(1185): n is a, c, g, or t
  misc_feature (1548)..(1548): n is a, c, g, or t
  misc_feature (1584)..(1584): n is a, c, g, or t
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagtaagtctaaatatgtcctattgagatttgagttacaaagttagctttatttattagattgtaatatacacctgtaattctactcttgatttggtagttgggtgtcaatttttaatgtttaatttcccaagagctttcactatgagtgttagataatatgacccaagtttaatgactaagtgaacaattgtcaaatgtagcaaaatgaaacaacttttaaaatctgagtcaccattttaaaaaaattgttatatcatttgagacattaacagatttttggtgacatccttttagccagtgatgacatgtaatctgtgtaaatgtgtagaaaattgaaattgttgaaaagaaaaatttgagggaatactggctaccatttactgagtacttgctatgttccagacacctttttaggtgctttacagaattatccactttaatgcctataacaatcatttgttacttgtcttcacctcctgttttacagatgactttcagtaacctgtccaggtacataagactcataagtaaaacttagacataaatctgactccaaagcctgtgcttctttgactacagtntaccctgtgttatttaacctcagttgagattcttctttcgtaaacctggagtgatgtataacagtaagatttgagaacttgctccttgtcaggttttatgcctgggatttaacaggtctatctcatttggcccttattaacagtccctaggagtagacactattttcttcccatttgacaagatgaggagtttaaggtaagaggttaaataacttgcctgaagtctctcagccagtaagtatggctctgacatttgaactggcttagtaattgcagagcatttgcttttttttttttttgagacggagtcttgctctgtcgcccaggctggagtgcagtggcacgatgtcagctcactgcaanttccgtctcctgggttgaagtgattctcctgcctcngcctcccaagtagctgggattacaggcgcccgccaccatgcctggctaatttttgtatttttagtagagacggggttttgccatcttggccaggctggtctcaaactcctgacctcaggtgatccgcccgcctctgtgtcccaaagtgctgggattaccggtgtgagccaccgcgcccagctgagcttttgctctttaccactaaagcagcagttcctaaatcttgctctatcatctggagaacaaattaagattcttggctagtagttgggggcacaaacccagttactattttttaaaagatctccaggtaatcttgccgagcagcactgtagtgtagtccactgtactgtagtgccttcttatcttgtagagctattgtgaggatcagcaccaatgtccgtagaggccctgacacaattccctaagctgatatttgatagagccttccataactgattgctaaattgtcttcataatttttcagtagcttctttcaataggaaacatttctttgctactataggaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348110 - DNA, 2812 bp, Homo sapiens
  misc_feature (1185)..(1185): n is a, c, g, or t
  misc_feature (1548)..(1548): n is a, c, g, or t
  misc_feature (1584)..(1584): n is a, c, g, or t
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagtaagtctaaatatgtcctattgagatttgagttacaaagttagctttatttattagattgtaatatacacctgtaattctactcttgatttggtagttgggtgtcaatttttaatgtttaatttcccaagagctttcactatgagtgttagataatatgacccaagtttaatgactaagtgaacaattgtcaaatgtagcaaaatgaaacaacttttaaaatctgagtcaccattttaaaaaaattgttatatcatttgagacattaacagatttttggtgacatccttttagccagtgatgacatgtaatctgtgtaaatgtgtagaaaattgaaattgttgaaaagaaaaatttgagggaatactggctaccatttactgagtacttgctatgttccagacacctttttaggtgctttacagaattatccactttaatgcctataacaatcatttgttacttgtcttcacctcctgttttacagatgactttcagtaacctgtccaggtacataagactcataagtaaaacttagacataaatctgactccaaagcctgtgcttctttgactacagtntaccctgtgttatttaacctcagttgagattcttctttcgtaaacctggagtgatgtataacagtaagatttgagaacttgctccttgtcaggttttatgcctgggatttaacaggtctatctcatttggcccttattaacagtccctaggagtagacactattttcttcccatttgacaagatgaggagtttaaggtaagaggttaaataacttgcctgaagtctctcagccagtaagtatggctctgacatttgaactggcttagtaattgcagagcatttgcttttttttttttttgagacggagtcttgctctgtcgcccaggctggagtgcagtggcacgatgtcagctcactgcaanttccgtctcctgggttgaagtgattctcctgcctcngcctcccaagtagctgggattacaggcgcccgccaccatgcctggctaatttttgtatttttagtagagacggggttttgccatcttggccaggctggtctcaaactcctgacctcaggtgatccgcccgcctctgtgtcccaaagtgctgggattaccggtgtgagccaccgcgcccagctgagcttttgctctttaccactaaagcagcagttcctaaatcttgctctatcatctggagaacaaattaagattcttggctagtagttgggggcacaaacccagttactattttttaaaagatctccaggtaatcttgccgagcagcactgtagtgtagtccactgtactgtagtgccttcttatcttgtagagctattgtgaggatcagcaccaatgtccgtagaggccctgacacaattccctaagctgatatttgatagagccttccataactgattgctaaattgtcttcataatttttcagtagcttctttcaataggaaacatttctttgctactataggaatttgcagcaccatcaacagatgcccctgataaaggatacgttgattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348111 - DNA, 1345 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaagagaactgccgtcctgatggaagagaacttggtgaattcagaaccacaactgtcaacatcggttcaattagtaccgcagatggttctgctttagtgaagttgggaaatactacagtaatctgtggagttaaagcatagcttctttcaataggaaacatttctttgctactataggaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348112 - DNA, 1269 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348113 - DNA, 998 bp, Homo sapiens
atacgtagcagcactgcaagatggcggcggggttcaaaaggcgatgtagaccttggtcgtatcatgtggaccatttgctgatacctggatcctgacgttacctgttggaatgactacactctggtagaaatatacagaccgcaggaatgtcgagcgtttgttgtcacatatatctcaccagtgagagtggttgcagctctatagacgagagggtcgggactcactacgtgacatgccaatctgtgagagttaatcgcagtaattgcgcagccctgtcaaagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348114 - DNA, 777 bp, Homo sapiens
tgtattgcttctggaaagttcatttggggttacaacaactaggatgggtggggtgagatgttcagatctggagaaatgacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348115 - DNA, 1236 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgagtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348116 - DNA, 1329 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactca

SEQ ID NO: 348117 - DNA, 2676 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccagaccaggcatgttcccgccacttcagtcctaaacatatgtagatgaaaactcagtgtgagccttaaattagggagggccaaatagaatatgggatattttatttacctaattttagtatagtttcttagctacctaaaatgttcttccatcttaatggtatatgtcagtggttcttaaacttaagacatacattagaatcacttggaggtcttgtgaaactaacttgtagatcttgagactgtaccctgatttacattatccaatttttttgttttataatttgacatgacattaatgttttttgaaaaggaatgataactgagattaaaagtattggcaaaataatttttcaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactcaattcttttgattcagtgctcttgtgtttttaaaaaaaggaacaaaaagtaatgcaagactcaaaattttggagtggttggcgtgcctctcttcattttactttttgactggctgcctgtatgccgatgatgatgtagctgagctgtttgtgctgctgctgctgccatagccatttgatgctgcaagaatcgcaactgctgcaaaagggagggaaaaaaatcgagttatgttaaatgcaggcaggtgtagaaaggtgcttttcctgagtgacgaaacaacacaactgaaaaagggagaaagcaccaagataacaaaaagggactataccacattgagacaatgcacagtcaaacagcaccagtggcacagaagcctgctaagggctttaaaaatgattcttggcaaacttcaaaattatttgttactttgccctgccagtctatattgtagtaactcagcaacttcagttaccattttgttgtataatgatggtttatagcaatataaaacaaccctgaatatcaagatagtcaactataatatgctgactttccttcctaaaattatggtataacatttttctaaataaacaggtatgacatttactaataggaacacttttctgcagtaaaatattagaaagttaacaattggcacttacaactgtctttcaaaatatactgcatactagaaaaatgtatgttaatgtgccaccagcacttcatgaaaaatttatagagtatggcttaaatatacaaaatatattcagtgctccaagttgactggctaaaatgtcagacttt

SEQ ID NO: 348118 - DNA, 1343 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348119 - DNA, 2360 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactcaattcttttgattcagtgctcttgtgtttttaaaaaaaggaacaaaaagtaatgcaagactcaaaattttggagtggttggcgtgcctctcttcattttactttttgactggctgcctgtatgccgatgatgatgtagctgagctgtttgtgctgctgctgctgccatagccatttgatgctgcaagaatcgcaactgctgcaaaagggagggaaaaaaatcgagttatgttaaatgcaggcaggtgtagaaaggtgcttttcctgagtgacgaaacaacacaactgaaaaagggagaaagcaccaagataacaaaaagggactataccacattgagacaatgcacagtcaaacagcaccagtggcacagaagcctgctaagggctttaaaaatgattcttggcaaacttcaaaattatttgttactttgccctgccagtctatattgtagtaactcagcaacttcagttaccattttgttgtataatgatggtttatagcaatataaaacaaccctgaatatcaagatagtcaactataatatgctgactttccttcctaaaattatggtataacatttttctaaataaacaggtatgacatttactaataggaacacttttctgcagtaaaatattagaaagttaacaattggcacttacaactgtctttcaaaatatactgcatactagaaaaatgtatgttaatgtgccaccagcacttcatgaaaaatttatagagtatggcttaaatatacaaaatatattcagtgctccaagttgactggctaaaatgtcagacttt

SEQ ID NO: 348120 - DNA, 2713 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccagaccaggcatgttcccgccacttcagtcctaaacatatgtagatgaaaactcagtgtgagccttaaattagggagggccaaatagaatatgggatattttatttacctaattttagtatagtttcttagctacctaaaatgttcttccatcttaatggtatatgtcagtggttcttaaacttaagacatacattagaatcacttggaggtcttgtgaaactaacttgtagatcttgagactgtaccctgatttacattatccaatttttttgttttataatttgacatgacattaatgttttttgaaaaggaatgataactgagattaaaagtattggcaaaataatttttcaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactcaattcttttgattcagtgctcttgtgtttttaaaaaaaggaacaaaaagtaatgcaagactcaaaattttggagtggttggcgtgcctctcttcattttactttttgactggctgcctgtatgccgatgatgatgtagctgagctgtttgtgctgctgctgctgccatagccatttgatgctgcaagaatcgcaactgctgcaaaagggagggaaaaaaatcgagttatgttaaatgcaggcaggtgtagaaaggtgcttttcctgagtgacgaaacaacacaactgaaaaagggagaaagcaccaagataacaaaaagggactataccacattgagacaatgcacagtcaaacagcaccagtggcacagaagcctgctaagggctttaaaaatgattcttggcaaacttcaaaattatttgttactttgccctgccagtctatattgtagtaactcagcaacttcagttaccattttgttgtataatgatggtttatagcaatataaaacaaccctgaatatcaagatagtcaactataatatgctgactttccttcctaaaattatggtataacatttttctaaataaacaggtatgacatttactaataggaacacttttctgcagtaaaatattagaaagttaacaattggcacttacaactgtctttcaaaatatactgcatactagaaaaatgtatgttaatgtgccaccagcacttcatgaaaaatttatagagtatggcttaaatatacaaaatatattcagtgctccaagttgactggctaaaatgtcagacttt

SEQ ID NO: 348121 - DNA, 951 bp, Homo sapiens
aaaaaaaaaaaaaaaaaaagatgggggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348122 - DNA, 1306 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348123 - DNA, 1382 bp, Homo sapiens
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcatagcttctttcaataggaaacatttctttgctactataggaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctga

SEQ ID NO: 348124 - DNA, 3026 bp, Homo sapiens
  misc_feature (1185)..(1185): n is a, c, g, or t
  misc_feature (1548)..(1548): n is a, c, g, or t
  misc_feature (1584)..(1584): n is a, c, g, or t
agcccttgaccagtgaagaggcaaggccagggctgagcctaagtcacaggcagaaaaaagacgcagaaacattggaataacgctccacacgcactgcttgattctgcgctagaaaccctgttatctccgaactgttggtgttattctgagttacagcaccagctcttttataaagaggaagacctgctccttctttaacagcagattcgtcaaaatacgtccaaggcaaggaaacctagaaaggcgtctgggcaggggaaagtcgatgcgagggcgggccagggacctttcgtcgcgtccccaccttggcatttcccgtggcgtgagcggccccggcatccgtgtcgaaagtgcggcggcggaacaggcgcgcaggagaggagcgggcaggcgcagacgcgcgggcgggaagatggcggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagtaagtctaaatatgtcctattgagatttgagttacaaagttagctttatttattagattgtaatatacacctgtaattctactcttgatttggtagttgggtgtcaatttttaatgtttaatttcccaagagctttcactatgagtgttagataatatgacccaagtttaatgactaagtgaacaattgtcaaatgtagcaaaatgaaacaacttttaaaatctgagtcaccattttaaaaaaattgttatatcatttgagacattaacagatttttggtgacatccttttagccagtgatgacatgtaatctgtgtaaatgtgtagaaaattgaaattgttgaaaagaaaaatttgagggaatactggctaccatttactgagtacttgctatgttccagacacctttttaggtgctttacagaattatccactttaatgcctataacaatcatttgttacttgtcttcacctcctgttttacagatgactttcagtaacctgtccaggtacataagactcataagtaaaacttagacataaatctgactccaaagcctgtgcttctttgactacagtntaccctgtgttatttaacctcagttgagattcttctttcgtaaacctggagtgatgtataacagtaagatttgagaacttgctccttgtcaggttttatgcctgggatttaacaggtctatctcatttggcccttattaacagtccctaggagtagacactattttcttcccatttgacaagatgaggagtttaaggtaagaggttaaataacttgcctgaagtctctcagccagtaagtatggctctgacatttgaactggcttagtaattgcagagcatttgcttttttttttttttgagacggagtcttgctctgtcgcccaggctggagtgcagtggcacgatgtcagctcactgcaanttccgtctcctgggttgaagtgattctcctgcctcngcctcccaagtagctgggattacaggcgcccgccaccatgcctggctaatttttgtatttttagtagagacggggttttgccatcttggccaggctggtctcaaactcctgacctcaggtgatccgcccgcctctgtgtcccaaagtgctgggattaccggtgtgagccaccgcgcccagctgagcttttgctctttaccactaaagcagcagttcctaaatcttgctctatcatctggagaacaaattaagattcttggctagtagttgggggcacaaacccagttactattttttaaaagatctccaggtaatcttgccgagcagcactgtagtgtagtccactgtactgtagtgccttcttatcttgtagagctattgtgaggatcagcaccaatgtccgtagaggccctgacacaattccctaagctgatatttgatagagccttccataactgattgctaaattgtcttcataatttttcagtagcttctttcaataggaaacatttctttgctactataggaatttgcagcaccatcaacagatgcccctgataaaggatacgttgattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaagttatttgaatattagaactcatccagttgcaacttcctttgctgtgtttgatgacactttgcttatagttgaccctactggagaggaggaacatctggcaacaggaaccttaacaatagtaatggatgaggaaggcaaactctgttgtcttcacaaaccaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactca

SEQ ID NO: 348125 - DNA, 2266 bp, Homo sapiens
aaaaaaaaaaaaaaaaaaagatgggggctgggttcaaaaccgtggaacctctggagtattacaggagatttctgaaagagaactgccgtcctgatggaagagaacttggtgaattcagaaccacaactgtcaacatcggttcaattagtaccgcagatggttctgctttagtgaagttgggaaatactacagtaatctgtggagttaaagcagaatttgcagcaccatcaacagatgcccctgataaaggatacgttgttcctaatgtggatctaccacccctgtgttcatcgagattccggtctggacctcctggagaagaggcccaagtggctagccagttcattgcagatgtcattgaaaattcacagataattcagaaagaggacttatgcatttctccaggaaagcttgtctgggttctatactgtgatctcatttgcctcgactacgatggaaacattttggatgcctgcacatttgctttgctagcggctttaaaaaatgtacagttgcctgaagttactataaatgaagaaactgctttagcagaagttaatttaaagaagaaaacactttgcttatagttgaccctactggagaggaggaacatctggcaacaggaaccttaacaatagtaatggatgaggaaggcaaactctgttgtcttcacaaaccagaccaggcatgttcccgccacttcagtcctaaacatatgtagatgaaaactcagtgtgagccttaaattagggagggccaaatagaatatgggatattttatttacctaattttagtatagtttcttagctacctaaaatgttcttccatcttaatggtatatgtcagtggttcttaaacttaagacatacattagaatcacttggaggtcttgtgaaactaacttgtagatcttgagactgtaccctgatttacattatccaatttttttgttttataatttgacatgacattaatgttttttgaaaaggaatgataactgagattaaaagtattggcaaaataatttttcaggtggaagtgggctaactggagctaaacttcaggactgtatgagccgagcagttacaagacacaaagaagttaaaaaactgatggatgaagtaattaagagtatgaaacccaaataaacagccaccacattttcaaaacagatttgtaaaaattgtatttgttaacactgtgcacaaacgttttatactaaataaatatcaaactacattcttctgaaagatgtttctattatttcttaggtcacttccatatatattatgtatagtgaaaccatttttaaaaagcaatgacttaggcaaaccaaccctagtttgttaaaccatttccctgtttttatttaaaaatgataaggttgtgcttctgtataaagtttgtacatctagcaatgtaaaatactgacacattaaaaaaaacaaaaagtagaaactcaattcttttgattcagtgctcttgtgtttttaaaaaaaggaacaaaaagtaatgcaagactcaaaattttggagtggttggcgtgcctctcttcattttactttttgactggctgcctgtatgccgatgatgatgtagctgagctgtttgtgctgctgctgctgccatagccatttgatgctgcaagaatcgcaactgctgcaaaagggagggaaaaaaatcgagttatgttaaatgcaggcaggtgtagaaaggtgcttttcctgagtgacgaaacaacacaactgaaaaagggagaaagcaccaagataacaaaaagggactataccacattgagacaatgcacagtcaaacagcaccagtggcacagaagcctgctaagggctttaaaaatgattcttggcaaacttcaaaattatttgttactttgccctgccagtctatattgtagtaactcagcaacttcagttaccattttgttgtataatgatggtttatagcaatataaaacaaccctgaatatcaagatagtcaactataatatgctgactttccttcctaaaattatggtataacatttttctaaataaacaggtatgacatttactaataggaacacttttctgcagtaaaatattagaaagttaacaattggcacttacaactgtctttcaaaatatactgcatactagaaaaatgtatgttaatgtgccaccagcacttcatgaaaaatttatagagtatggcttaaatatacaaaatatattcagtgctccaagttgactggctaaaatgtcagacttt

SEQ ID NO: 348126 - DNA, 1020 bp, Homo sapiens
agcgggtttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 348127 - DNA, 1059 bp, Homo sapiens
cttccggactccaggtaccgcgcttgggcgactgcgccccagacttctgtcttttcagctgcagtgaaggctcggggctgcaggctggagtgcagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 348128 - DNA, 690 bp, Homo sapiens
aagaaaaaaaaaaggaagaaaaaatgaagtagggtttatggatccggaagaaggcctcagttaatagaaagtagctgagattgaattagtaactgccccaagttggtcctcgattattttttcaagttgctttattttactagcttctgaaagtttgtttcttcccaaacctttctcttataaaccctcatccaaggttttcagaacaacaggttctgatttttccttattcatttagcgaacattttaaagtggctaattcagttatgtctgggatgttttaatcctccaaggggttgagctgggagagcccccaagccaaggattagtaacactactgggtaggcgagtgcatggccctttctgtcttatgccagataaaagtgactctccctttgtctttgttttattttaaatccagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatga

SEQ ID NO: 348129 - DNA, 1109 bp, Homo sapiens
agcgggtttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaaaatgacaaatagatacattatcattctgtgaactccacttaagacttcctttatgtgacgtcgacgcggccgcgaatttagtagtagta

SEQ ID NO: 348130 - DNA, 710 bp, Homo sapiens
agcgggtttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatga

SEQ ID NO: 348131 - DNA, 1144 bp, Homo sapiens
agcgggtttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcaggctggagtgcagtggcacgactcacagttgattgcaacctctgcctcgcaggttcaagggattttccggtctcagcctcctgagtagctgggattacagacatgcaccaccatgccacgtccggaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 348132 - DNA, 851 bp, Homo sapiens
  misc_feature (4)..(4): n is a, c, g, or t
  misc_feature (17)..(17): n is a, c, g, or t
  misc_feature (46)..(47): n is a, c, g, or t
aaanctcattcaactanaggtgagatataaattggtacatgcgtcnnttaaaagcggggcacagcgtcagtgagtggtggatgtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 348133 - DNA, 798 bp, Homo sapiens
gagctggtccggctgatcttgccggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 348134 - DNA, 721 bp, Homo sapiens
caagcattgataacatgtttgaaactctggttcatgaattagtttggttttcagttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 348135 - DNA, 1000 bp, Homo sapiens
aagaaaaaaaaaaggaagaaaaaatgaagtagggtttatggatccggaagaaggcctcagttaatagaaagtagctgagattgaattagtaactgccccaagttggtcctcgattattttttcaagttgctttattttactagcttctgaaagtttgtttcttcccaaacctttctcttataaaccctcatccaaggttttcagaacaacaggttctgatttttccttattcatttagcgaacattttaaagtggctaattcagttatgtctgggatgttttaatcctccaaggggttgagctgggagagcccccaagccaaggattagtaacactactgggtaggcgagtgcatggccctttctgtcttatgccagataaaagtgactctccctttgtctttgttttattttaaatccagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 348136 - DNA, 672 bp, Homo sapiens
agcgggtttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaattgctatttttttctttaaaaaattttattcttagcacactgttatgtcctaactgaatgtattcagtattcaaataaaagacattttggttcaaa

SEQ ID NO: 348137 - DNA, 710 bp, Homo sapiens
agcgggtttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccacgctcgtcttgctgctcctcttgacaattctgcggaccagtctattaaccctatcgtatccctcgtctcccgtactcagcatcctccttagcgcattcttcacatctcctctcaacctgttctctctactcacacactttcaactcttcacatttaactatgatccgctctcctctcgccatccttctcttccatcctaaatttctctttctgctcataatactcgctaccgttctctcttatatccctcctctggtccatatactcatactctctcccctcccttcctccacgcctctattcctc

SEQ ID NO: 348138 - DNA, 1207 bp, Homo sapiens
cttccggactccaggtaccgcgcttgggcgactgcgccccagacttctgtcttttcagctgcagtgaaggctcggggctgcaggctggagtgcagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaaaaaaaaaaaaaacaaaaaaaaaaaaattttgggggccccggccagaaaattttaaacacaccgtggggcgggccagggtaggaaccgtcaactgcccaggagaccggccacaagggggggtccccaaaaacggggacgggttgaaaac

SEQ ID NO: 348139 - DNA, 1168 bp, Homo sapiens
agcgggtttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaaaaaaaaaaaaaacaaaaaaaaaaaaattttgggggccccggccagaaaattttaaacacaccgtggggcgggccagggtaggaaccgtcaactgcccaggagaccggccacaagggggggtccccaaaaacggggacgggttgaaaac

SEQ ID NO: 348140 - DNA, 950 bp, Homo sapiens
agcgggtttccaggagggagcggcctttgctcagcgcgagacggctgggcgccgagtgggacagcgctggtgcggagactgcttccggactccagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 348141 - DNA, 1084 bp, Homo sapiens
  misc_feature (182)..(182): n is a, c, g, or t
  misc_feature (189)..(189): n is a, c, g, or t
  misc_feature (201)..(201): n is a, c, g, or t
  misc_feature (205)..(205): n is a, c, g, or t
  misc_feature (210)..(210): n is a, c, g, or t
cttccggactccaggtaccgcgcttgggcgactgcgccccagacttctgtcttttcagctgcagtgaaggctcggggctgcaggctggagtgcagtgggacagcgctggtgcggagactgcttccggactccaggtaccgcgcttggcggcagctggccccagacttctgtcttttccaggnccccccntttttggggggncccnaggtntgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 348142 - DNA, 1003 bp, Homo sapiens
agcgggtttccaggagggagcggcctttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaaggtaagtaaaactattttgatcaatactttcctctgctgttgttttgaagtgctgaatttttgggaaacatcaattttaatttgaaagatcaaagtcctttttgttataataagcatgacagtaaaaaccttaagatagcatggattcagtgggtctttgatattgatgtacccatgaacattcttattggatacgcatagtgttgctgtagtatctggtcacataggcatacttgcctttttcagaagaaagagctaactaaactcagcctcatttttcctcaagattcacccatctgcaacactaaatgtgttcatttaaatctaatactcagtcccttttagagagtttgacagagtgacagtgtgatacagttatttcaagtttttaagggacagaaatttaatatttttaagagtttttaagagagaagttttaatattttttaaaagataaacagagggcctcaagtttctcttaatttgatccagtaattctatccatgagattaagcatattaccaaataaaaatttagagataacattttaaaaatttctccag

SEQ ID NO: 348143 - DNA, 336 bp, Homo sapiens
cctgggcgacagagcgagattctgtctcaaaaaaaaaaaaaattgaatttatttgttatcagcaggttaaaaagataccaaaaaaagaggtcaaaaatattaactgtagtagtctccggacagtggacttatggacaaatttcttaagctttaaaaaatacttacatgtacttgccaccttttccatagtgagtactctgttaatactcaggagaaaataggccaagcatggtggctcacatctgtaatcctagcactttgggaggccaagatgggaggattggttgaggccaggagttcgagaccagcctggtcaacacagagagctcccatctc

SEQ ID NO: 348144 - DNA, 823 bp, Homo sapiens
caatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccagaggccagcagacctcttcctgaggacttctgtttaaaggaggacgaggaggaggttggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttca

SEQ ID NO: 348145 - DNA, 801 bp, Homo sapiens
caatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgcagcaggagcttctgaacatgaagctatggaccatccacgagctgctgcaagatagcaagccggacaaggatatggaggcttcagaaccagaggccagcagacctcttcctgaggacttctgtttaaaggaggacgaggaggaggttggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttca

SEQ ID NO: 348146 - DNA, 882 bp, Homo sapiens
caatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgcagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggaggttggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttca

SEQ ID NO: 348147 - DNA, 1097 bp, Homo sapiens
caatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcaggtgggtttagcagaagtctgtgctgggtcgggggagtttaggggacagcagaagatacataaccacttctgcccccttttttcccttatccccagagcaacagctggcccagttgacacaacagctggcccagacagagcagcacctgaacaacctgatggcccagctggaccccctttttgagcggtgaggagagcaatgattctgtgaatttttggggaatttgtggcaggagggaggaatggggacataggttgggagccactgagtggacatttcttcagtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggaggttggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttca

SEQ ID NO: 348148 - DNA, 904 bp, Homo sapiens
caatgccggaccgcttcggcaccgcccgcccgatccctccacccgtgggccggcaatggcgggcgcagtttcgctcttgggtgtggtggggctgctgcttgtgtctgcgctgtccggggtcctaggagaccgcgccaatcccgacctccgggcacacccagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggaggttggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttca

SEQ ID NO: 348149 - DNA, 376 bp, Homo sapiens
attaagaaactgaggctcagagaggtcaagctactttcccaaggtcacatagccagcaagtgaaggagccaaggtacaaatgcagacttcttgacttctcagatgctgctaactcctatggtaaactatgaggagccaacctaggagaaaagaagaaaacacaatagaatgatttcacagaatgagcttagattatagaatatctgaatccacctatgacttgtaagcccttgcttcaagatatcccaccttttcgggctgaaccaatatatactttccaggtatcgatttatgcttttgcctgtaactcctactacctccttgaaatgtataaaaccaatctgtaatttaaccacctcaggaccaaacttgttgg

SEQ ID NO: 348150 - DNA, 359 bp, Homo sapiens
cctctccagcacctgttgtttcctgactttttaatgatcgccattctaactggtgtgagatggtacctcattgtggttttgatttgcatttctctgatggccagtgatggccatcccaccacactcgtcccacctggcttgtgtcaatgttccattactgttcaccggctgcccacgcacctccagctccacatcagaatgtgttgctagacgtcattgtcatggtggcaggaggaatttgttaaacttcaaaggaatgcctgtttgtcataaagcctttaaaacaagaagatggcatctcctatgtgggaggagtgaggtttgatcctgcggaaaataaacttagctgacattttcga

SEQ ID NO: 348151 - DNA, 688 bp, Homo sapiens
ctcccctcttccttggctcttgggaaggaacctctgccctcagagttttagccagatgctaagaatatccaaatagcaagagttacaaaagatcagttaaaaaacaaagatgtgagaactgatattgaaggacaccccactgctttggataagccttctgcatgtagtggctaaagggctgagaaatccggagtcagtaccagggatacaagttcagtgaggaggggagatggcaaggagctggtgactacagctacagtctctctgatatctacatcatacacaacctttccaatgtcaaatggcttccttcagaaaaggtcctattggcatttgggaggcatcaagctgactcttctcatctccttactgggtcagatataggaatccaactcagcagggcaggttaaccgcaaaacagcaaggaagataatggtcagagaacgggaacacatgtgcttgtctaggaaaagcaagtcagattttctaatctttagctattttttttaaacactgagttataggaaatcaaacttaccaaactttattagatttcacagtagaataatctaaagttgtctttttggttttttttttttagcttttaaaagacttttgtttaagctattcaacaaaacaatgtgctacagaatgatttttccttaacacaaccagatgtctacaaaga

SEQ ID NO: 348152 - DNA, 288 bp, Homo sapiens
gaggtgagaccagcctgagcaacgtagtgtgacttcgtttctataaataaataaataataaaaattatatccatcctattagtttctactatctttagaaaaagaggccaaggcaggcagatcacctgaggtcagaagttcaagaccagcctgacccacgtagagaaaccccatctcttctaaaaatacaaaattagctgggtgtggtggcacatgcctgtaatcccagctatatgggaggctgaggcaagagaatcacttgaacccaggaggcggaggttgtggtga

SEQ ID NO: 348153 - DNA, 483 bp, Homo sapiens
attcgcggccgcgtcgacagtgagaccctatctctctatgttgcctagactggtttcaaaatcccgggctcaagtgatccacctgtcttggcctcccaaaatgctgggattactggcacaaacaccgcacccgaccctctgcagctacttactcctcctaagcatcagccctctcatctctgaaatatggctcttcctgcctacctcaaatattggctgtaaggatgaaaataaacaatgaagataagggttttgcagagcttctggtccataacaagtacttaatacttcttttggacatatatttaataagtgcctacgtgtaccatatgctgatctaggtgttggaaattcctaatagaagaaactcctttttctcatggagcttacaatgttgatgccagtggcaaacgagttgacccattgttacgtggaaacaaatggtatgaaaagaacctggggtaagcagatggaagaagggag

SEQ ID NO: 348154 - DNA, 253 bp, Homo sapiens
aaaaaattagctagacgtcgtggtgggcacctgtaatcccagctactcaggaggctgaggcaggagaatcgcttgaatccaggaggcggaggttgcagtgagtcaagatcacgccattgcactccaacctggatgacagagcaagactccatctccaaaagaaaaacaaagatggaggccgggcatggtggctcacacctgtaatcccagtggcaattcacttgagattaggagttcaagaccagcctcgtca

SEQ ID NO: 348155 - DNA, 1350 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcccgagtgcgggaaccctgtggttgcccctcctgatgttgggggtggcctgctgtttgccgggagctggac

SEQ ID NO: 348156 - DNA, 4154 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348157 - DNA, 3591 bp, Homo sapiens
tagagctaggaaaggcctggtgttaatcaggcgaggccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348158 - DNA, 3605 bp, Homo sapiens
atactgagccctataaacttgacgaggcccccgttggttttaagtgtcgcagcagcgtaggacctacgtcctccgggggttagggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348159 - DNA, 3405 bp, Homo sapiens
  misc_feature (18)..(18): n is a, c, g, or t
taggctaggtacgaggcngggtgttaatcggccgaggccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348160 - DNA, 4188 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatctcccaggtgtggtcagacatgacacttcgtgcag

SEQ ID NO: 348161 - DNA, 4193 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatcgtcaaaaaataataaaataatatatgtatatgatgatat

SEQ ID NO: 348162 - DNA, 4209 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaagggccccagaactatggacctcggccggggcctgccctcacacgcttgggcccacagtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348163 - DNA, 3543 bp, Homo sapiens
ggcgctttcgtgttatgagcatgggccttggctctgacaattgacacgcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348164 - DNA, 3593 bp, Homo sapiens
cggcctggtacggtcggaagtcttagatccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348165 - DNA, 3566 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccaatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348166 - DNA, 2862 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccgggtaggacccccactttcctatcctctcctggcaaatcagcagctcctggctaggggtctttggtgcagggtgcagggtctcatcctacttgtaacagttgctgtccctttaagcaatgaaccaggccgatcgcgatggtggctcatggttgtaatcccagcactttgggaggcctaacaggaaggatcgcatgagctcaggagttaagagaccagcctgggcaacattttatttttactaaaaataaaaaaaaatcagccgagcgtgatggtg

SEQ ID NO: 348167 - DNA, 3123 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacgcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgccccaccatcgcaaagatccaacccttcaggtcagttcaagttctggctcagattccaagcggcttttttggtccgaattgctatcacgctgagtcctggctgctgttcaag

SEQ ID NO: 348168 - DNA, 387 bp, Homo sapiens
actaaaaatagaaaattagccgggcgcggtggctcatgcctgtaatcccagctactcgggaggctgaggcaggagaattgcttgaacctgggaggcagaggttgcagtgagccgagatcacgccattgcattccagcctgggcaacaagagccaaactccgtctcaaaataaacaaacaaactaactaaagaagcctaacagtaaatggcagctggtgtgtatgtgaccctgttgctctgcttcctccagggacacggccaacacggtgaaggaaaagttcgggaggaagctttatgaatccttactggtgtgagtgccccaccctcagccctgtgccctcctaggccctgactaacccctctcattactccgttctcacatgcatg

SEQ ID NO: 348169 - DNA, 483 bp, Homo sapiens
ctggtgccacagagtcctggagaccatgaagatctccccaggatgttttctgaacctgggtcctggcctccacaggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccgggtaggacccccactttcctatcctctcctggcaaatcagcagctcctggctaggggtctttggtgcagggtgcagggtctcatcctacttgtaacagttgctgtccctttaagcaatgaaccaggccgatcgcgatggtggctcatggttgtaatcccagcactttgggaggcctaacaggaaggatcgcatgagctcaggagttaagagaccagcctgggcaacattttatttttactaaaaa

SEQ ID NO: 348170 - DNA, 422 bp, Homo sapiens
tgtggtgatctagaggaccccgtacagcccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccttggatcaggcagattctctgaagtagatccctgacactaaggaactgcttgaagctaaatggcctcctggcagtctgtccaaccttcaggtcactcagcctacagttggga

SEQ ID NO: 348171 - DNA, 3967 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348172 - DNA, 4364 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatcaaaaaaaataaaaaaaaaaaaaaaacatcgttcggagcgcttcattactccgggggtcggaaacaaagggggtatctagcaggcgcccttgggtcaaagcggtttcccctgagcccacagttttcctttgcccacagggggcaacattggcgcggtccccctatagggagccgcgaaaaaattcgcaaaagcccggttaccctgtagatg

SEQ ID NO: 348173 - DNA, 4154 bp, Homo sapiens; identical to SEQ ID NO: 348156

SEQ ID NO: 348174 - DNA, 4164 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348175 - DNA, 3331 bp, Homo sapiens
  misc_feature (15)..(16): n is a, c, g, or t
  misc_feature (21)..(21): n is a, c, g, or t
ggcacgagggacaanntgcgntttaaaggcatggctggcgcaggaaggggggctccggggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348176 - DNA, 2652 bp, Homo sapiens
  misc_feature (18)..(18): n is a, c, g, or t
taggctaggtacgaggcngggtgttaatcggccgagggtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacggcagcgagcagacagtggttgccttcttcatcatgccagcgcggaccaacaatttcaacgtggaaaccctcaaaggccaagctgtgcgcaaacagctttgggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348177 - DNA, 2248 bp, Homo sapiens
ggcagctggtgtgtatgtgaccctgttgctctgcttcctccagggacacggccaacacggtgaaggaaaagttcgggaggaagctttatgaatccttactggttgggagccttcccgacatgaacaagatgctggataaggaagacttcactatgatgaagagagccatctttgcaacgcagcggcagtctttcccccctgtgtgcacccacaatatgctggatgactcctcagaccccatcctgaccaccatccgccgaatcggcctcttcaatagcagtgccgacagggtgaaggtgattttccacccggagttcctctcctccacaagccccctgctccctgtggactatgaggagtttgtccgtggctgtcaccttggagtcttcccctcctactatgagccttggggctacacaccggctgagtgcacggttatgggaatccccagtatctccaccaatctctccggcttcggctgcttcatggaggaacacatcgcagacccctcagcttacggtatctacattcttgaccggcggttccgcagcctggatgattcctgctcgcagctcacctccttcctctacagtttctgtcagcagagccggcggcagcgtatcatccagcggaaccgcacggagcgcctctccgaccttctggactggaaatacctaggccggtactatatgtctgcgcgccacatggcgctgtccaaggcctttccagagcacttcacctacgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348178 - DNA, 1597 bp, Homo sapiens
tcatcagctcggtcccccttttcagccgggtgggtaggaccgtagactcgctcatctcgcctgggtttgtccgcatgttgtgccgcagctgcgagcccaacgaggcggatgcggcccaggggtaccgctacccacggccagcctcggtgccaccgtcgccctcgctgtcacgacactccagcccgcaccagagtgaggacgaggaggatccccggaacgggccgctggaggaagacggcgagcgctacgatgaggacgaggaggccgccaaggaccggcgcaacatccgtgcaccagagtggccgcgccgagcgtcctgcacctcctccaccagcggcagcaagcgcaactctgtggacacggccacctccagctcactcagcaccccgagcgagcccctcagccccaccagctccctgggcgaggagcgtaactaagtccgccccaccacactccccgcctgtcctgcctctctgctccagagagaggatgcagaggggtgctgctcctaaacccccgctccagatctgcactgggtgtggccccgcagtgcccccacccagtccgccaaacactccaccccctccagctccagtttccaagttcctgcactccagaatccacaaagccgtgcctttctctggctccagaatatgcataatcagcgccctggagtcccctgggcctggaccgcttcccagaggccaggaatctgccattactctgcggtggtgccagaggttttaggaaacctggcatggtgctttcaggtctggggcttttagagccccccgtgtggcttacaaattctacagcatacagagcaggccacgctcaggcccggcatgcgggccaccaagttctggaaaccacgtggtgtccctgcgaatggggcgatcaagtccagagccggggcactttcagagtttgaaggtaactgagagcagatggtcctccatttcaactccagaagtggggctctgggagggatgttctagccctccctggcatgtcagagccaggctctgcctggaggatccctccatccggctcctgtcatcccctacactttggccaagcaagaggtggtagaaccacttggctgctcattccttctggaggacacacagtctcagtccagatgccttcctgtctttctggccctttctggaccagatcctactcttcctttctaaatctgagatctccctccagggaatccgcctgcagaggacagagctggctgtcttcccccacccctaacctggcttattcccaactgctctgcccactgtgaaaccactaggttctaggtcctggcttctagatctggaaccttaccacgttactgcatactgatccctttcccatgatccagaactgaggtcactgggttctagaacccccacatttacctcgaggctcttccatccccaaactgtgccctgccttcagctttggtgaaagggagggcccctcatgtgtgctgtgctgtgtctgcaccgcttggtttgcagttgagaggggagggcaggaggggtgtgattggagtgtgtccggagatgagatgaaaaaaatacatctatatttaagaatc

SEQ ID NO: 348179 - DNA, 1913 bp, Homo sapiens
agtcctagcggaaacggaaacgcgcgaggagcgagatgttctggctcctctaggctagctggttcttcaaagatctcgatggttcctcataaatatgtaaatattgtgggggcgtggcgggactttatgccccgccctcccaccgaggctgcgctggaagacgggcgtccggaactcctgggtccattcccaatgtctcctggctcctcctccttttgctcagccccaccaccgccccgctcaggccgattgcaaaattcttagctgttctttgagtaaccacacgtcctccacgctcctttcctctttatcccaccctcctcctcctccccactttgaggcctccagctccagattgacagagctgaaggccactcgtttccgtaaagcgcagcggcaagctccgccccctggaggtctcacggccgaggcggggccgggacacagcgactccaacccgttccaccaatgaggacacgcggaaatccccgcccccgggcgtgggccaatggcgctggctggggggggcggccaccgcctcctggcggctgcgaggtttcactgcaggggcgccagtgggctcagtgacgctgcggcctccttctgcctaggtcccaacgcttcggggcaggggtgcggtcttgcaataggaagccgagcgtcttgcaagcttcccgtcgggcaccagctactcggccccgcaccctacctggtgcattccctagacacctccggggtccctacctggagatccccggagccccccttcctgcgccagccatgcctttaaaccgcactttgtccatgtcctcactgccaggactggaggactgggaggatgaattcgacctggagaacgcagtgctcttcgaagtggcctgggaggtggctaacaaggtgggtggcatctacacggtgctgcagacgaaggcgaaggtgacaggggacgaatggggcgacaactacttcctggtggggccgtacacggagcagggcgtgaggacccaggtggaactgctggaggcccccaccccggccctgaagaggacactggattccatgaacagcaagggctgcaaggtgtatttcgggcgctggctgatcgagggaggccctctggtggtgctcctggacgtgggtgcctcagcttgggccctggagcgctggaagggagagctctgggatacctgcaacatcggagtgccgtggtacgaccgcgaggccaacgacgctgtcctctttggctttctgaccacctggttcctgggtgagttcctggcacagagtgaggagaagccacatgtggttgctcacttccatgagtggttggcaggcgttggactctgcctgtgtcgtgcccggcgactgcctgtagcaaccatcttcaccacccatgccacgctgctggggcgctacctgtgtgccggtgccgtggacttctacaacaacctggagaacttcaacgtggacaaggaagcaggggagaggcagatctaccaccgatactgcatggaaagggcggcagcccactgcgctcacgtcttcactactgtgtcccagatcaccgccatcgaggcacagcacttgctcaagaggaaaccagatattgtgacccccaatgggctgaatgtgaagaagttttctgccatgcatgagttccagaacctccatgctcagagcaaggctcgaatccaggagtttgtgcggggccatttttatgggcatctggacttcaacttggacaagaccttatacttctttatcgccggccgctatgagttctccaacaagggtgctgacgtcttcctggaggcattggctcggctcaactatctgctcagagtgaacgcagcgagcagacggtgttgccttcttcatcatgcctgcgaacctatgagggatcctctagacga

SEQ ID NO: 348180 - DNA, 2322 bp, Homo sapiens
  misc_feature (850)..(850): n is a, c, g, or t
  misc_feature (1021)..(1021): n is a, c, g, or t
  misc_feature (1027)..(1027): n is a, c, g, or t
  misc_feature (1152)..(1152): n is a, c, g, or t
  misc_feature (1286)..(1286): n is a, c, g, or t
  misc_feature (1630)..(1630): n is a, c, g, or t
aacaaaagttttcccaaacctaaatcctttttcttcaatcgtgcttaaattcactgtttttttaccccagagtaaggaagtcaggcagagggctgggggaaattcaggaagtgtccatctgtcaattaatggagctcccgagaattttcctcaggtagatttcttccactgataacttgagtttggttttgtctaatgtttcaaggttgagaagtggaagatgggtattcagtataaaatatggagataagagtgggggaaagcctgcagactcagtgatggtctaaggacatatatgataaatgaaaatttctcagaagtacaaaagacttctctcagaagattaaacatctcctagaaggcttatgaaattaaagtccaatttttttaagaacatcgtccttggattgaaaggttgaatcaaaagcatgataattgaatttacttacaatacagagttatgagctattgcaagggtgaagtgatagattttcaagataaccagtttggttctgaagctggtccttatttactcctctgccttccattgcagctctggttacccacgtatttcctttaatgagttaagtaagtaatgcccatggacttggtctctgcagggccactcctatgcagaggtctccgcttgtgttttagaggtataaatatctgcccttagctctgccatggttcctggcatttaatcatcaattgaaagtagtatgtctataagggcagagcattatctataacgtaaattccatgcaatgtgctgccttctgttgtggatttcctgccagcaccagtcagagattagaggcagctggagtgggagaaaggtggctcgganacatacatccgtaaactatagaaccaccaatcaaaatctattctatttcctcatctccctaaccactaattattttttacacattacctctttttacttactatcctctaaattcatgttcattttatttttattattttttttagaggcgggggtcttgccatgttacanaggctngtcttgaactcctggccttaagcaatccgcctcggcctcccaaagtgctgggactataagtgtgagccactgcatctggccctctaagttcattgtaaactggcttctcctttatacaagctaanacttaagaccacatgaatgattaagcctagcctccctcctcattcagccaaatgattagtgaacacttttttcaatatttttttttcagtatgttgggcattaagaatccaaagattagagtctaccaaagganaaggcaatgggagtaaatagacaaagtgcttggagagcattgagaaatgagtgatttatttcatcagagacctgtagaggccttccagggacaaagatatttcggtttagtcttgaggtatgtaggatatcttcaggtaaagaaatttaaaaaggacatcaaaatgggatatacatacatgtacacacacatgtcatccacacacatacatatatatatgtttgtatggatatgtgtgtgtatgtgtgtgtatacacagaaccgacagatttcctcatgtctgaaaacaataacatttaagaatatcttaagagtatataagttcttgagatttaacacctgancccctaacatccaagtttagatgagtagtcattcattcaacagataatcatcaaggactcacagtctgccagacactgctaggtaagcatcaaggatgcaaagacagtaaatacaggacatgttttctgcccttaagaaactcacagtttccctgaaaactagttaatcactatggaaaacagggtcccgtgagaaaagaattttatgcaagaacaaggtgaagatggagtcataacataagacatcctttaggaaagaaagcccaggctggtaatcccaaattgagatttttccagggccactaggaaaggctaaggatgccttggaagaaaaagggaaacaaaactagagaaaaggctgttgaaagaggacagaccaagtagcaaacaaattttggccgaaatgaaccaaaaattcatcattctaccaggtggctggtacccttttagaactttttattctgagatgtgttataagccactctttacaaaagaggcaactaagtaattttcccaaggttacacagcaagggtgagaactaaggtctttctgatgcaaaatctaccctctttctacaacacccaatcgcccttcaattttatctcacaattgctaccagaggctcattgtttaactggcttgtccataccctctgcaatacactgctttcaacaaaaatcagaattgtgtc

SEQ ID NO: 348181 - DNA, 2575 bp, Homo sapiens
  misc_feature (850)..(850): n is a, c, g, or t
  misc_feature (1021)..(1021): n is a, c, g, or t
  misc_feature (1027)..(1027): n is a, c, g, or t
  misc_feature (1152)..(1152): n is a, c, g, or t
  misc_feature (1286)..(1286): n is a, c, g, or t
  misc_feature (1630)..(1630): n is a, c, g, or t
aacaaaagttttcccaaacctaaatcctttttcttcaatcgtgcttaaattcactgtttttttaccccagagtaaggaagtcaggcagagggctgggggaaattcaggaagtgtccatctgtcaattaatggagctcccgagaattttcctcaggtagatttcttccactgataacttgagtttggttttgtctaatgtttcaaggttgagaagtggaagatgggtattcagtataaaatatggagataagagtgggggaaagcctgcagactcagtgatggtctaaggacatatatgataaatgaaaatttctcagaagtacaaaagacttctctcagaagattaaacatctcctagaaggcttatgaaattaaagtccaatttttttaagaacatcgtccttggattgaaaggttgaatcaaaagcatgataattgaatttacttacaatacagagttatgagctattgcaagggtgaagtgatagattttcaagataaccagtttggttctgaagctggtccttatttactcctctgccttccattgcagctctggttacccacgtatttcctttaatgagttaagtaagtaatgcccatggacttggtctctgcagggccactcctatgcagaggtctccgcttgtgttttagaggtataaatatctgcccttagctctgccatggttcctggcatttaatcatcaattgaaagtagtatgtctataagggcagagcattatctataacgtaaattccatgcaatgtgctgccttctgttgtggatttcctgccagcaccagtcagagattagaggcagctggagtgggagaaaggtggctcgganacatacatccgtaaactatagaaccaccaatcaaaatctattctatttcctcatctccctaaccactaattattttttacacattacctctttttacttactatcctctaaattcatgttcattttatttttattattttttttagaggcgggggtcttgccatgttacanaggctngtcttgaactcctggccttaagcaatccgcctcggcctcccaaagtgctgggactataagtgtgagccactgcatctggccctctaagttcattgtaaactggcttctcctttatacaagctaanacttaagaccacatgaatgattaagcctagcctccctcctcattcagccaaatgattagtgaacacttttttcaatatttttttttcagtatgttgggcattaagaatccaaagattagagtctaccaaagganaaggcaatgggagtaaatagacaaagtgcttggagagcattgagaaatgagtgatttatttcatcagagacctgtagaggccttccagggacaaagatatttcggtttagtcttgaggtatgtaggatatcttcaggtaaagaaatttaaaaaggacatcaaaatgggatatacatacatgtacacacacatgtcatccacacacatacatatatatatgtttgtatggatatgtgtgtgtatgtgtgtgtatacacagaaccgacagatttcctcatgtctgaaaacaataacatttaagaatatcttaagagtatataagttcttgagatttaacacctgancccctaacatccaagtttagatgagtagtcattcattcaacagataatcatcaaggactcacagtctgccagacactgctaggtaagcatcaaggatgcaaagacagtaaatacaggacatgttttctgcccttaagaaactcacagtttccctgaaaactagttaatcactatggaaaacagggtcccgtgagaaaagaattttatgcaagaacaaggtgaagatggagtcataacataagacatcctttaggaaagaaagcccaggctggtaatcccaaattgagatttttccagggccactaggaaaggctaaggatgccttggaagaaaaagggaaacaaaactagagaaaaggctgttgaaagaggacagaccaagtagcaaacaaattttggccgaaatgaaccaaaaattcatcattctaccaggtggctggtacccttttagaactttttattctgagatgtgttataagccactctttacaaaagaggcaactaagtaattttcccaaggttacacagcaagggtgagaactaaggtctttctgatgcaaaatctaccctctttctacaacacccaatcgcccttcaattttatctcacaattgctaccagaggctcattgtttaactggcttgtccataccctctgcaatacactgctttcaacaaaaatcagaattgtgtcaaaaaaatttcaaaaaaaggtcatgcatatggaactaccacttaaagtaggggcgatatgagaatagaaaccaactagaatgtcctgagtagatataattgagaaataggagagatatagtatattcttgagatacttggatacttgagaggaaaagcccttgtccagactttctttgactcaagaaagggagaatagtgattcagaaagggaagagttattattgttttctcaggactcaacattgtgcctc

SEQ ID NO: 348182 - DNA, 700 bp, Homo sapiens
ggccagactggtcagttttgacttttcatccccctagaagtgaatgtttcagcttatttatttatttctaatttttaaaaagttgtagaagtcctaaaaagactagcctcaattcgtaaaaaaagagttattgggtttgaaaatgtgaaataccaagactgatcattgagggaagcagtgaggttaggggaattgttccgaagggtggtactcacgcttttctatttggaaaatcaaatgacagaagccttttctcatttcatagaaaattgagatgtttgtttttctttctcccataaatgttttctttcttaagtaagtgccaaaagtttgttatttgactgctaacagaaaacactgttaatggggacactcaaatgtgatttttaaaaatatcttatatattttatatattgagttgtattttcttgtagtaaaattcctagttcatatggatgaattaaatattaccgttccatgttgatctgccactcagaaccagtttgggaaccatgatctatcctgattattgggtaaataacagatgtttacaatattcaacattgttcccattgccctcttaatcatcatctccgggaggttatgcttaacaaagctaaaagtcctcatttatgcttcaaactctggcccaattggaagtgatttcgtatattaattaataaagtgtaccaaactggga

SEQ ID NO: 348183 - DNA, 833 bp, Homo sapiens
ggccagactggtcagttttgacttttcatccccctagaagtgaatgtttcagcttatttatttatttctaatttttaaaaagttgtagaagtcctaaaaagactagcctcaattcgtaaaaaaagagttattgggtttgaaaatgtgaaataccaagactgatcattgagggaagcagtgaggttaggggaattgttccgaagggtggtactcacgcttttctatttggaaaatcaaatgacagaagccttttctcatttcatagaaaattgagatgtttgtttttctttctcccataaatgttttctttcttaagtaagtgccaaaagtttgttatttgactgctaacagaaaacactgttaatggggacactcaaatgtgatttttaaaaatatcttatatattttatatattgagttgtattttcttgtagtaaaattcctagttcatatggatgaattaaatattaccgttccatgttgatctgccactcagaaccagtttgggaaccatgatctatcctgattattgggtaaataacagatgtttacaatattcaacattgttcccattgccctcttaatcatcatctccgggaggttatgcttaacaaagctaaaagtcctcatttatgcttcaaactctggcccaattggaagtgatttcgtatattaattaataaagtgtaccaaactgggaaaaaaaaaaaaaagtatgttgagtccataattgcatttcagtatctcagtgggaggttaggctgctggatggaaaacagtgctggaccttcacctttcttgacttagctaagtgaacagatggggtgttggtc

SEQ ID NO: 348184 - DNA, 675 bp, Homo sapiens
tccgggtgtgggtgtgggtcccgggggacggcggcccaccctgcgggttcgaatccgggcgctggcacctctcgacgctaggcccgcgccggtcgcggtaatggcagccaccatttgccgagcgcttgccaagagcagggccgcacgacataggcgccctgtgtccctcagacagcagcccggtgtgacaggcagaatccgtaatcccattttacagaataggatatcagggcctaaggagctttgcccaaggtcacacagctcgagagagccagaagcggggttcaaaaccgcgtcgccctactccagatactgctctcttactcgctgccctcggcttccccacgtgggttcactgacgaagttgcgtggaccccggttcccccaggaggggtattgacgtttcccaagttttgaggcttaacggaaaatgcaactgaagcgcctggcacagtgttggggacgcagtaaatgctcaaggaatgatgattatggatacacctattacatatatggtaaaataacgctttatatcatctgtctcctttaggatttggggtggaaggcaggcatggtcaaacccatttcactgacaggagagcagagacaggacgtgtctctctccacgtcttccacctgactatggtctagaggcctggctacttttggtcctgg

SEQ ID NO: 348185 - DNA, 4413 bp, Homo sapiens
gaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatc

SEQ ID NO: 348186 - DNA, 4552 bp, Homo sapiens
gaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccagtaaaattcctagttcatatggatgaattaaatattaccgttccatgttgatctgccactcagaaccagtttgggaaccatgatctatcctgattattgggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatc

SEQ ID NO: 348187 - DNA, 4498 bp, Homo sapiens
gaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccagtaaaattcctagttcatatggatgaattaaatattaccgttccatgttgatctgccactcagaaccagtttgggaaccatgatctatcctgattattgggtgcatgtttgcctacaagctgggtctgaatgacttgccccagtcagtcgcctttttcagtgcagtcgatattgaccggtgcctcaggaaggaagtgaccatggattgtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatc

SEQ ID NO: 348188 - DNA, 4166 bp, Homo sapiens
gaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccagtaaaattcctagttcatatggatgaattaaatattaccgttccatgttgatctgccactcagaaccagtttgggaaccatgatctatcctgattattgggtaaataacagatgtttacaatattcaacattgttcccattgccctcttaatcatcatctccgggaggttatgcttaacaaagctaaaagtcctcatttatgcttcaaactctggcccaattggaagtgatttcgtatattaattaataaagtgtaccaaactgggaaaaaaaaaaaaaagtatgttgagtccataattgcatttcagtatctcagtgggaggttaggctgctggatggaaaacagtgctggaccttcacctttcttgacttagctaagtgaacagatggggtgttggtc

SEQ ID NO: 348189 - DNA, 3730 bp, Homo sapiens
gaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtaagaaccttctttgtgttaaggatggagggaggggtctgggcttgccccagaagagcttggatgctttgttttttagctttgagatgctgaaagacaaagtctgccctctgtttctggtcccttaggtcacagtggaagaagtgggaggtggttgctgaacgggcatggaaggggggcacagagtcagaaatgttcaataagcttgagagcattgctacgtctgacataccacgtaccccgtgccctagaaggggaaagaattaatgctctaacgtgataaacctgctccaaggcagtggaaataaaaagaaggaaaaaaaagactctatcttctcatc

SEQ ID NO: 348190 - DNA, 1219 bp, Homo sapiens
ggccagactggtcagttttgacttttcatccccctagaagtgaatgtttcagcttatttatttatttctaatttttaaaaagttgtagaagtcctaaaaagactagcctcaattcgtaaaaaaagagttattgggtttgaaaatgtgaaataccaagactgatcattgagggaagcagtgaggttaggggaattgttccgaagggtggtactcacgcttttctatttggaaaatcaaatgacagaagccttttctcatttcatagaaaattgagatgtttgtttttctttctcccataaatgttttctttcttaagtaagtgccaaaagtttgttatttgactgctaacagaaaacactgttaatggggacactcaaatgtgatttttaaaaatatcttatatattttatatattgagttgtattttcttgtagtaaaattcctagttcatatggatgaattaaatattaccgttccatgttgatctgccactcagaaccagtttgggaaccatgatctatcctgattattgggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatc

SEQ ID NO: 348191 - DNA, 178 bp, Homo sapiens
ctggagccctcggctgtccaggaagaggtatcttgctacctttggagcatgggcagaggggccccagggagggcagggcagagctccctgtggaccttaccaatgtttgtaggtagggccagagtgaagcttctcttggggcttctaccctggagttaattggtatgtagcatagccc

SEQ ID NO: 348192 - DNA, 418 bp, Homo sapiens
ctggccagacagtgacaggcgtaatagctacagctctcatggaatttagataggaccatgtaggtgaggggtctggcatagcgctaggcatagagtagattctttacctgtcacaccaattgctgataggtggccatctctggaactgtggaatttcagcagtgctgtctggcattctctaaagccatcccctcaggaaaggctctagctctttctcagtcaactctggctccaggaatggggtaggaagagtctcatttgggtatctcactcttcccacagcctgaccgagtaggcagtgagttgaaagccatggtgcaggccccacctggctacacccttgtgggtgctgatgtggactcccaagagctgtggattgcagctgtgcttggagacgcccactttgccggcatgcatg

SEQ ID NO: 348193 - DNA, 4453 bp, Homo sapiens
gaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatc

SEQ ID NO: 348194 - DNA, 595 bp, Homo sapiens
cataaggctgtgcagccatgcatgccggcaagtgggcgtctccaagcacagctgcaatccacagctcttgggagtccacatcagcacccacaagggtgtagccagggtgggcctgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtgagggtccctctcccatccactttaacacccaggacccgaggcctgctttactgtccatctgacccatcttaagatgggtcagatggacttattcatctggctcagcttaatacatgttggcctaatgctacaaatacctaacattaaaaaaagtctgagggtataaacaagtacagaccacagtcactggcagcaatgatttggcctggaggtgcacctgcggctgtgcggcagaccaggcctcagaaccagtaatcag

SEQ ID NO: 348195 - DNA, 4435 bp, Homo sapiens
gaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatcagcatccatgacgaggttcgctacctggtgcgggaggaggaccgctaccgcgctgccctggccttgcagatcaccaacctcttgaccaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatc

SEQ ID NO: 348196 - DNA, 4002 bp, Homo sapiens
gaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatc

SEQ ID NO: 348197 - DNA, 3602 bp, Homo sapiens
gaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccgtgccctagaaggggaaagaattaatgctctaacgtgataaacctgctccaaggcagtggaaataaaaagaaggaaaaaaaagactctatcttctcatc

SEQ ID NO: 348198 - DNA, 177 bp, Homo sapiens
gcgtggcacaggaagcactcccgtggaatgatggtgataacactgcccccaggtatcggctgtcggatgagggcgagtggctggtgagggagttgaacctcccagtggacaggactgagggtggctggatttccctgcaggatctgcgcaaggtccagagagaaactgcaaggaagt

SEQ ID NO: 348199 - DNA, 206 bp, Homo sapiens
tttttttttttgagccagggtcttcctctgttgcccaggctggagtgcagtggtgccgtcacagctcactgcaacctacacctcctggactcaagcgatccttctgcctcagccccccagtagctgggactacaggtgcgagcccggctaatattttttggatgcagtttcaccatgttaaccatgctggtcttgaactactgagc

SEQ ID NO: 348200 - DNA, 306 bp, Homo sapiens
gatcctgggacctcccagcgccctgcagacgtgcacattcccagtccgtgccctagccgtcctgggtccccttacaagcccgggtctgccacttcacccttgtttttccccatcctccgggtccacatttcatatgcccctgccctcattcccttatgattccctagctgctggttccagagtcttctgggcttacagtctcccggccctcggggagttccgaccccttctttccaatcatcccctttacccgcctgccctcagccccgaggacccctccccgcgcccggctcctgggcgccggtg

SEQ ID NO: 348201 - DNA, 444 bp, Homo sapiens
aagacaaaatgaaaaagagatggaagcggggcatggtggctcacatgtttaatcctagctagttgggaggctgagatgggaggattgcttgagtcccggtggtcaaggctggagtgagctattattgtaccactgtgctccagccagggcaacagagtgagaccctgctgtatcttaaaaaggaaaaagggttgggcgtgatggttcacgcctgtaatcccagcactttgagacgccaaggtgggtggatgacttcagcccgaaaatttgagaccagcctgggaacatagtgagacctcatctctacaagaaatacaaaaattatttgggtgtggtggtgcctgcctgtagtcccagctactcaggaggctgaactaggtggaatgcttgaggccagaaggttgaggctgcagtgagccctgatcttgccactgcactccaacc

SEQ ID NO: 348202 - DNA, 2504 bp, Homo sapiens
gcgtgcacgtggccatccttctccaggaggcgacgaggcagtcccgcctggggtctcccggcggcgcgtccgactcttttcctcgaggctgaggctgccgaggctgtcgttccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccaccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaacaaaaaaggatt

SEQ ID NO: 348203 - DNA, 3233 bp, Homo sapiens
gcccgagggctgccggctgccggccgagggcggccccgccaccgaccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccaccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaacaaaaaaggatt

SEQ ID NO: 348204 - DNA, 3337 bp, Homo sapiens
gcccgagggctgccggctgccggccgagggcggccccgccaccgaccaggtgatggcccagccagggtccggctgcaaagcgaccacccgctgtcttgaagggaccgcgccgcccgccatggctcagtctgacgccgaggccctggcaggagctctggacaaggacgagggtcaggcctccccatgtacgcccagcacgccatctgtctgctcaccgccctctgccgcctcctccgtgccgtctgcaggcaagaacatctgctccagctgcggcctcgagatcctggaccgatatctgctcaaggtcaacaacctcatctggcacgtgcggtgcctcgagtgctccgtgtgtcgcacgtcgctgaggcagcagaacagctgctacatcaagaacaaggagatcttctgcaagatggactacttcagccgattcgggaccaagtgtgcccggtgcggccgacagatctacgccagcgactgggtgcggagagctcgcggcaacgcctaccacctggcctgcttcgcctgcttctcgtgcaagcgccagctgtccactggtgaggagttcggcctggtcgaggagaaggtgctctgccgcatccactacgacaccatgattgagaacctcaagagggccgccgagaacgggaacggcctcacgttggagggggcagtgccctcggaacaggacagtcaacccaagccggccaagcgcgcgcggacgtccttcaccgcggaacagctgcaggttatgcaggcgcagttcgcgcaggacaacaaccccgacgctcagacgctgcagaagctggcggacatgacgggcctcagccggagagtcatccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccaccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaacaaaaaaggatt

SEQ ID NO: 348205 - DNA, 2608 bp, Homo sapiens
gcgtgcacgtggccatccttctccaggaggcgacgaggcagtcccgcctggggtctcccggcggcgcgtccgactcttttcctcgaggctgaggctgccgaggctgtcgttccaggtgtggtttcaaaactgccgggcgcgtcataaaaagcacacgccgcaacacccagtgccgccctcgggggcgcccccgtcccgccttccctccgccctgtccgacgacatccactacaccccgttcagcagccccgagcgggcgcgcatggtcaccctgcacggctacattgagagtcaggtacagtgcgggcaggtgcactgccggctgccttacaccgcaccccccgtccacctcaaagccgatatggatgggccgctctccaaccggggtgagaaggtcatcctttttcagtactaacgctgccggcacttccgcatctgcccgtgggcgccccacagctgcccctcagccgctgagatccagtgtccaagctgcggccaggagtccacccacctccgcatccacccccgtccgccatcctgcccaccaccaggtcggttcccgaggcctggcctttccctctcctgctgagaaccagaacccaccaggagcaccacagagtcctcctcttggaaggcagaactccctgaaatctggaatcagggtggaaacagcctgtttttcccatttaaacaggagtcctcttcaacttcagctgattacaataacaaaaggcggaattgaattgtgcgatgccaacggccttctcatttacaggtttttttcccccacattggcctttatttactacttccttggaaccatctctgaattctgaatagctgacaacccccaatgttatccactctgttgcttttgtctggaaaactctacagtgtttgtgggatgtccccaaaggaaagctatgttctaattttatcatttccatctgtctggttatgtcaagttaattcagaaagagaagagacagtgaccaaccctgagaggcctaatagggcagagatggaggcctgcccagactaggaggcagcggggatagacagggaatggggagaagaaagacccccattggtttggaaatcaaggagagggcggtgacatattggaccagaagaggcactagccattttaaggagaggaaagagaaaactctggggtcagggagagaccctacccccacctaattatccagcatatatgtaagaaacatagcagcgatggtattcgatctgtgccatgactcttctgaatgtttggacaggttagagttggggacccctgttggccacttgttgacctctcatagtggtgcttgggccaggtcttctcaatggaaggggaatcccttataggggagagggaacagagcccagtgaaatggcagtcagaatgttaaccctggatccatctctaagtagagagagggtgcccattgcctaggtgagtgtgccaagctcaggattccaactggtgcctctgagcttcccaatcaatacttcctggagccagccccacccacccctgagaacagaggtcagacacagctgcgtaacatccatcctgctacaactcttccaccccaaacaaaagggctcaggctacacacgaccatgatttatgttttcaggggatgcccatttgtcccaagcttatcctgtaattctagaattacctggtgtcctgatgcattttccactagaggttgctaatcagcatgttttagcccaagtccaccttcctgctgtggttaacctgttatgttgcttttggaaggagactctaagacagggaaagcaagttcatggtacatacgcagccattgtctctgtttttacccatggcagacattgctaatcaatggcagctctatttcactgagtctggataaggtttcagagttcaaatgcttgacgttggcacttaacatgaaagcctataggtcattcttgctctgggatctacaggcagggtaggcacaggtgcagcctaagaagggaacctgcttcctctcccttccaaagacagtgacagctgactgagggcaaagagcaggcaccactcagaacgtggtgagtacagctcagctcagcactcagtcagtggtaacttgtgcccagccctgtgctaggcgctgacattaacaggagcaaccagggcccaattcctggccttggagctcaaatctttcctttgatttttgctcctgatcatcaaggccccagtggcaaccatgtggtaagtggccaaccaagccctacccagggtcacccaacacactctgccttgagcctctcctcagggtctattccttgcgtggattatgtggccgtagcatgttacagttcaaacatgtctccactaccctgttaagagcagcctgggaacgtacaggccatcaagactatttatttaaatacaaaaaaaggggaaaacacacacacggaaaaaaaattgtaagcactttttttgtaaaaccaatgtctgttttgttacatacctttcatgtcgtgctttgtaaatgtcttatttgtgtaataaagttaatgcaagtagaagtgctggcactgaaatccagaacaaaaaaggatt

SEQ ID NO: 348206 - DNA, 3269 bp, Homo sapiens
ctagaattcagcggccgctgaattctagagagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgc

SEQ ID NO: 348207 - DNA, 1384 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttc

SEQ ID NO: 348208 - DNA, 3393 bp, Homo sapiens
  misc_feature (3385)..(3385): n is a, c, g, or t
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgcaaaaaaaaaaaaaaaacaaaaaaaaaaaaaaaaaaaaaaaaaaaaaaaaaaaaaaaaaaaacaaaaanaaaaaaca

SEQ ID NO: 348209 - DNA, 3969 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtagcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaagaattgagccactgcactccagcctgggcgacagagcgagactctgtcttaaaaaaaaatatatata

SEQ ID NO: 348210 - DNA, 3106 bp, Homo sapiens
  misc_feature (3098)..(3098): n is a, c, g, or t
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgcaaaaaaaaaaaaaaaacaaaaaaaaaaaaaaaaaaaaaaaaaaaaaaaaaaaaaaaaaaaacaaaaanaaaaaaca

SEQ ID NO: 348211 - DNA, 3243 bp, Homo sapiens
  misc_feature (34)..(34): n is a, c, g, or t
  misc_feature (61)..(61): n is a, c, g, or t
  misc_feature (70)..(70): n is a, c, g, or t
  misc_feature (72)..(73): n is a, c, g, or t
  misc_feature (76)..(76): n is a, c, g, or t
  misc_feature (3235)..(3235): n is a, c, g, or t
gctagcacgaactgaaatgaccgcacccataaanctccccgctgctgtgctttctactcgntcctgccantnntgntccgagcgccccagagcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgcaaaaaaaaaaaaaaaacaaaaaaaaaaaaaaaaaaaaaaaaaaaaaaaaaaaaaaaaaaaacaaaaanaaaaaaca

SEQ ID NO: 348212 - DNA, 3141 bp, Homo sapiens
  misc_feature (3133)..(3133): n is a, c, g, or t
ctagaattcagcggccgctgaattctagagagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgcaaaaaaaaaaaaaaaacaaaaaaaaaaaaaaaaaaaaaaaaaaaaaaaaaaaaaaaaaaaacaaaaanaaaaaaca

SEQ ID NO: 348213 - DNA, 2750 bp, Homo sapiens
  misc_feature (2742)..(2742): n is a, c, g, or t
agttaagactagtttcatatgctgcgtgagtgagtgaaacaggcctagaatgctcagatctgggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgcaaaaaaaaaaaaaaaacaaaaaaaaaaaaaaaaaaaaaaaaaaaaaaaaaaaaaaaaaaaacaaaaanaaaaaaca

SEQ ID NO: 348214 - DNA, 2290 bp, Homo sapiens
  misc_feature (2282)..(2282): n is a, c, g, or t
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaaaaaaaacaaaaanaaaaaaca

SEQ ID NO: 348215 - DNA, 1295 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgta

SEQ ID NO: 348216 - DNA, 1506 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaatcagcacatttagtagcgcatgtaatctgcaacattctggcccatgatgtgcttccgatgtacttctgcattaaattccttgctttcagaatcataaccagggaatcgtttggtactgtgagggatagacaagcctccatccacagctcccttcagggcaccaaaaactttattgccagcggtagttctggcaaggcctgactccaaatagcaggtgagggcactggctgaccatcaatgcttccacatgtatcatcaccagtcactccattggcttctagatcttgtca

SEQ ID NO: 348217 - DNA, 956 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacgtaagatcctctaaaccttctttttgtttaagttagagatggatgggggcggtgacgttgtttaatagaatatatctgttcattcagttgcctgttttgtggttgaacctgtgatagccaccagggaagcaaagataaattgcacgtttcttcttcaagtctaatccagtgggggaggcatatgaaaacaggcactagaacatgctgataagtg

SEQ ID NO: 348218 - DNA, 242 bp, Homo sapiens
tacatcaagtcagaatgatgttgacatgagttggattcctcaggaaacattgaatcaaatcaaagtagtcttacagacttggctgggaagtttttctcttaagtggaaattaaataccttagatttagtttaaaaaaaaaactttttcagtactatttaacattcatcttttccattacttgtgtagaatctagtatagtgattaattaagaccttaaaggtttattcagtgtgtagtcttc

SEQ ID NO: 348219 - DNA, 3430 bp, Homo sapiens
  misc_feature (3422)..(3422): n is a, c, g, or t
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgcaaaaaaaaaaaaaaaacaaaaaaaaaaaaaaaaaaaaaaaaaaaaaaaaaaaaaaaaaaaacaaaaanaaaaaaca

SEQ ID NO: 348220 - DNA, 3376 bp, Homo sapiens
  misc_feature (3368)..(3368): n is a, c, g, or t
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgcaaaaaaaaaaaaaaaacaaaaaaaaaaaaaaaaaaaaaaaaaaaaaaaaaaaaaaaaaaaacaaaaanaaaaaaca

SEQ ID NO: 348221 - DNA, 3375 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgttcatgggggtcccttttgtgtctctgagaataatgtgttcataaagcatgtcttcagcaagacagcacatacacctaag

SEQ ID NO: 348222 - DNA, 3302 bp, Homo sapiens
  misc_feature (3294)..(3294): n is a, c, g, or t
ctagaattcagcggccgctgaattctagagagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagcaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgcaaaaaaaaaaaaaaaacaaaaaaaaaaaaaaaaaaaaaaaaaaaaaaaaaaaaaaaaaaaacaaaaanaaaaaaca

SEQ ID NO: 348223 - DNA, 2588 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgta

SEQ ID NO: 348224 - DNA, 1519 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaacatagattgagaacagttgaactcttaaatcctcagatgccaggggtctgctctagcatcaacgcaggaggagggagacgcactgatgacatcgggccgctcctgcagctcgggcgcctcgcagtctccaggtgcaaggccagcgcttccgccgtggctgcttcaggacatcccccagcacagccgttcctggagacccggccatcttttctgcatcgttttgcaatttgtgaaacttaggacagcagccgcctgttcaaccgggccctccgccggat

SEQ ID NO: 348225 - DNA, 1290 bp, Homo sapiens
ggcctgctctccccacctctccgcgctgagcagccacgtcggcggcggtccctggtccagggaggggcgtggcaaaggcccgtgcgcggtacgtgtcccgcccctcgctgcccggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttc

SEQ ID NO: 348226 - DNA, 1006 bp, Homo sapiens
ctagaattcagcggccgctgaattctagagagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgta

SEQ ID NO: 348227 - DNA, 329 bp, Homo sapiens
accaaatggacctaaaagacatttacagcatatttaatccaaaattacagtatacacattcttctcatcaccacatggaacattttcaaagatataccatatgttaggacacaaaagaagtcccaacaaatgttttacaaatcaaaatcatgtcaagtattttctcaggcaacaataaaaaataatctagaaatcaataacaacgggaactttggaaactgtgtaaatatgtgtaaattaaacaagatgtccctgaatggcaattagttcaatgaaaaaattaaggagaaaattattaacaattttttggaacatatgaatatcaaaac

SEQ ID NO: 348228 - DNA, 916 bp, Homo sapiens
tcatcgggggcggcgcggggaggggtggtgtggacggagaaagtgaaaggtgaggcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaagatgagcagcagctgctcagggctgagcagggtcctggtggccgtggctacagccctggtgtctgcctcctccccctgcccccaggcctggggccccccaggggtccagtatgggcagccaggcaggtccgtgaagctgtgttgtcctggagtgactgccggggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctaccctccagcccgccctgttgtctcctgccaagcagccgactatgagaacttctctt

SEQ ID NO: 348229 - DNA, 388 bp, Homo sapiens
atcctggggctaggcactggatggaggttgctcccagtagggtcagcatctggaccccaggctgagagtcaggctctgattccagatctagcctccatcatgaagaagctcttgaccaagtatgacaacctctttgagacgtcctttcctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348230 - DNA, 1503 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348231 - DNA, 1805 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacggtaactgcaccgcggcagggactcgctggggcgcggagccgagccctccccttccttaggaagctttcgtcccctccgaaggttggaacgctcatcccgagccagaccgacaaggcgtacagtctgcaggcctgtacgagcagcaggccaattggcgctgggaaagtccaatcctgggcctctagctcctgagcgggacagggccgagagggcgctcccgagcttgggcctgctggtgggtgagacccaggagagagggagctagagagctctgaggactgatcttgactgtctgcccccagaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348232 - DNA, 1831 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggtgaggcttttcaagtacctatatttagccccaacaccatttctgggctcctggggctcagcctagtgaactgcaacctcaaaggagcaagccttgaaacagttgctgggggaagtggccagagtagagatgctgggactgagggtggagcagcaaacttggtgaaactacatctccaatgtgctttctaatctcctgccagctcttctcaagcaggggatcctgggagatgtagttttcagatacctggttgggtttgggagtaggtgctaacctggataactgtaaaagggctctctctccccactgtctctcttctttctgtcaggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348233 - DNA, 1879 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaatatcagaggagtgtgaaccttcagagatctagggttaaaagctaaaggcatagctccagctacaacttttctttgtctacagatgtgtaaaatcttgatgcaaaaatctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaagggg

SEQ ID NO: 348234 - DNA, 2251 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacggtaactgcaccgcggcagggactcgctggggcgcggagccgagccctccccttccttaggaagctttcgtcccctccgaaggttggaacgctcatcccgagccagaccgacaaggcgtacagtctgcaggcctgtacgagcagcaggccaattggcgctgggaaagtccaatcctgggcctctagctcctgagcgggacagggccgagagggcgctcccgagcttgggcctgctggtgggtgagacccaggagagagggagctagagagctctgaggactgatcttgactgtctgcccccagaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtaagcctgtagagccctgcatctgcaggctgggccacggggagtagttccctcttagaactgtcctccacccacagggatagtgaacctccttctgggtcatatcccaccaagctttttggtcccctagggtgggccttccctactcccttgtagcctgtccagtctttgaagcccaccaggtaactggtggtatggggcagtgagtgcttctagcctatccttgtcggtgtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348235 - DNA, 2082 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacggtaactgcaccgcggcagggactcgctggggcgcggagccgagccctccccttccttaggaagctttcgtcccctccgaaggttggaacgctcatcccgagccagaccgacaaggcgtacagtctgcaggcctaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtaagcctgtagagccctgcatctgcaggctgggccacggggagtagttccctcttagaactgtcctccacccacagggatagtgaacctccttctgggtcatatcccaccaagctttttggtcccctagggtgggccttccctactcccttgtagcctgtccagtctttgaagcccaccaggtaactggtggtatggggcagtgagtgcttctagcctatccttgtcggtgtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348236 - DNA, 1327 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggtcaggactcagaacagtctggcgtctccaga

SEQ ID NO: 348237 - DNA, 1871 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcaggtttgtgaggtcgccccttcccctggatgggcagggagggggtgatgaagctttggttctggggagtaacatttctgtttccacagggtgtggtcaggagggagttgacttggtgtcttttggctaacagagctccgtatccctatctgatagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348238 - DNA, 2539 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcaggtatgggccagcagtttcctgccagatattgcccagcgtgaggagcgatctcagcaggcctataagagtcagcatggagagcccctgctaatggagtacagccgccaggagctactcaggaaggtgggagagagccaagccctgtgtccccaaggagtccctaactttcttatcccatgagagaggtgtgtaaaggagaaagctagaggtgaactagtagagagagacttgctaggaggccttagcaataatccagtaatctaaaggaaagatgatggtgacttagactcgggtggttagtggtagaggtggtgagaagacatcagatcctgggcacattcttttcttctgcttcccttgcctatttgctgaccacactccggctcctatgtcaccttgatgacttcctatccattctgtcttcctaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggtgaggcttttcaagtacctatatttagccccaacaccatttctgggctcctggggctcagcctagtgaactgcaacctcaaaggagcaagccttgaaacagttgctgggggaagtggccagagtagagatgctgggactgagggtggagcagcaaacttggtgaaactacatctccaatgtgctttctaatctcctgccagctcttctcaagcaggggatcctgggagatgtagttttcagatacctggttgggtttgggagtaggtgctaacctggataactgtaaaagggctctctctccccactgtctctcttctttctgtcaggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaatatcagaggagtgtgaaccttcagagatctagggttaaaagctaaaggcatagctccagctacaacttttctttgtctacagatgtgtaaaatcttgatgcaaaaatctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaagggg

SEQ ID NO: 348239 - DNA, 2685 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggtgggagagagccaagccctgtgtccccaaggagtccctaactttcttatcccatgagagaggtgtgtaaaggagaaagctagaggtgaactagtagagagagacttgctaggaggccttagcaataatccagtaatctaaaggaaagatgatggtgacttagactcgggtggttagtggtagaggtggtgagaagacatcagatcctgggcacattcttttcttctgcttcccttgcctatttgctgaccacactccggctcctatgtcaccttgatgacttcctatccattctgtcttcctaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggtgaggcttttcaagtacctatatttagccccaacaccatttctgggctcctggggctcagcctagtgaactgcaacctcaaaggagcaagccttgaaacagttgctgggggaagtggccagagtagagatgctgggactgagggtggagcagcaaacttggtgaaactacatctccaatgtgctttctaatctcctgccagctcttctcaagcaggggatcctgggagatgtagttttcagatacctggttgggtttgggagtaggtgctaacctggataactgtaaaagggctctctctccccactgtctctcttctttctgtcaggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaatatcagaggagtgtgaaccttcagagatctagggttaaaagctaaaggcatagctccagctacaacttttctttgtctacagatgtgtaaaatcttgatgcaaaaatctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaagggg

SEQ ID NO: 348240 - DNA, 1386 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaagaagggggcaaccaggagcctggaagacggggcccttaggggacacgggcgtacgacgaacagctgcgtgcccggcgcctgtgggggggaagcggaacgcaaccggggacgggagatatacaccccgcagggaagaccgtgacagagtacgcacactgtaagagcgtctcctacccaggggcgcggtgccacgacagaggggcacgggacgcaaagtggccacaacaccgcaacggagaggtcataacgtcgcgaactgactaggcaccgcagaaagagcgaacatcgagctagaccctgaattttgtaggcattatctctgttgactgaggagacac

SEQ ID NO: 348241 - DNA, 1363 bp, Homo sapiens
tcatcgggggcggcgcggggaggggtggtgtggacggagaaagtgaaaggtgaggcacggccctgcagattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348242 - DNA, 1963 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaatatcagaggagtgtgaaccttcagagatctagggttaaaagctaaaggcatagctccagctacaacttttctttgtctacagatgtgtaaaatcttgatgcaaaaatctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaagggg

SEQ ID NO: 348243 - DNA, 2291 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggtgaggcttttcaagtacctatatttagccccaacaccatttctgggctcctggggctcagcctagtgaactgcaacctcaaaggagcaagccttgaaacagttgctgggggaagtggccagagtagagatgctgggactgagggtggagcagcaaacttggtgaaactacatctccaatgtgctttctaatctcctgccagctcttctcaagcaggggatcctgggagatgtagttttcagatacctggttgggtttgggagtaggtgctaacctggataactgtaaaagggctctctctccccactgtctctcttctttctgtcaggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaatatcagaggagtgtgaaccttcagagatctagggttaaaagctaaaggcatagctccagctacaacttttctttgtctacagatgtgtaaaatcttgatgcaaaaatctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaagggg

SEQ ID NO: 348244 - DNA, 1715 bp, Homo sapiens
  misc_feature (1547)..(1547): n is a, c, g, or t
  misc_feature (1552)..(1552): n is a, c, g, or t
  misc_feature (1562)..(1562): n is a, c, g, or t
  misc_feature (1575)..(1575): n is a, c, g, or t
  misc_feature (1577)..(1577): n is a, c, g, or t
  misc_feature (1579)..(1579): n is a, c, g, or t
  misc_feature (1584)..(1584): n is a, c, g, or t
  misc_feature (1588)..(1588): n is a, c, g, or t
  misc_feature (1597)..(1597): n is a, c, g, or t
  misc_feature (1601)..(1603): n is a, c, g, or t
  misc_feature (1607)..(1607): n is a, c, g, or t
  misc_feature (1620)..(1620): n is a, c, g, or t
  misc_feature (1623)..(1624): n is a, c, g, or t
  misc_feature (1626)..(1627): n is a, c, g, or t
  misc_feature (1629)..(1629): n is a, c, g, or t
  misc_feature (1646)..(1646): n is a, c, g, or t
  misc_feature (1651)..(1651): n is a, c, g, or t
  misc_feature (1661)..(1661): n is a, c, g, or t
  misc_feature (1679)..(1680): n is a, c, g, or t
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaaaaaaaaaaaaaaaaaaaaaaaaaaaaaacccccgggggccctntatgngggggggggngaaaaagaggggnangngaaangggncacggggcncaannngggnccccgggccccanttnntnngnccaagggggaaaactcnggcgngggcccccanaaaggggggccggataanntccggaaaacccgggtacccggataatgaacggaa

SEQ ID NO: 348245 - DNA, 1738 bp, Homo sapiens
  misc_feature (1738)..(1738): n is a, c, g, or t
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaaaaaaaaaaaaaaaaaaaaaaaaaaaaaactctggggggttttattgtgtgtgggggggggaaaaaggggggtatgtgtgaagtgggccatgtggggctatatggggtgtttccctgtaacccaggtttttttgtgtccaggggggaaaattgggggggccccccaaaatgggggggggaattaaattcgagaaaaggccgggttcacccggtttttataccttctgggaaaagn

SEQ ID NO: 348246 - DNA, 1629 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348247 - DNA, 1718 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctggtaactatggatttcccctcttacaactttcaaaccagagttggagactcagcattggggttcggccctgcccgtagcacagccaagccctacctctcggttatcttttctcccgtcaccacccagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348248 - DNA, 1378 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagagtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348249 - DNA, 2818 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacggtaactgcaccgcggcagggactcgctggggcgcggagccgagccctccccttccttaggaagctttcgtcccctccgaaggttggaacgctcatcccgagccagaccgacaaggcgtacagtctgcaggcctaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggtaacctggctccaactgctgctggggaggagggtggctagacctcttgagggacttctgctgcagagagtgatactcctttacctcaggacccagtgatcatccccttttccaagcaaagtctgctcgaggagtctgtaaggtcatgtgcttccacccctggtcggatgtaacgctgccactcatgtcggtccctgagatccgggctgttgttgatgcatgggcctcagtcacagaggagctgggtgcccagtacccttgggtgcagatctttgaaaacaaaggtgccatgatgggctgttctaacccccacccccactgccaggtatgggccagcagtttcctgccagatattgcccagcgtgaggagcgatctcagcaggcctataagagtcagcatggagagcccctgctaatggagtacagccgccaggagctactcaggaaggtgggagagagccaagccctgtgtccccaaggagtccctaactttcttatcccatgagagaggtgtgtaaaggagaaagctagaggtgaactagtagagagagacttgctaggaggccttagcaataatccagtaatctaaaggaaagatgatggtgacttagactcgggtggttagtggtagaggtggtgagaagacatcagatcctgggcacattcttttcttctgcttcccttgcctatttgctgaccacactccggctcctatgtcaccttgatgacttcctatccattctgtcttcctaggaacgtctggtcctaaccagtgagcactggttagtactggtccccttctgggcaacatggccctaccagacactgctgctgccccgtcggcatgtgcggcggctacctgagctgacccctgctgagcgtgatgatctagcctccatcatgaagaagctcttgaccaagtatgacaacctctttgagacgtcctttccctactccatgggctggcatggtgaggcttttcaagtacctatatttagccccaacaccatttctgggctcctggggctcagcctagtgaactgcaacctcaaaggagcaagccttgaaacagttgctgggggaagtggccagagtagagatgctgggactgagggtggagcagcaaacttggtgaaactacatctccaatgtgctttctaatctcctgccagctcttctcaagcaggggatcctgggagatgtagttttcagatacctggttgggtttgggagtaggtgctaacctggataactgtaaaagggctctctctccccactgtctctcttctttctgtcaggggctcccacaggatcagaggctggggccaactggaaccattggcagctgcacgctcattactaccctccgctcctgcgctctgccactgtccggaaattcatggttggctacgaaatgcttgctcaggctcagagggacctcacccctgagcaggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaaacttttatcacatactctaatatcagaggagtgtgaaccttcagagatctagggttaaaagctaaaggcatagctccagctacaacttttctttgtctacagatgtgtaaaatcttgatgcaaaaatctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaagggg

SEQ ID NO: 348250 - DNA, 821 bp, Homo sapiens
caggactgaagcggagaggaggcagttcaagctgggagccccagggtgggcattccagaggcggtgacacctgagcagtgtctttaagagctcgcagaaggggcatgccagcccacagggaccagcccctagagcaaaggcctccgaggagagacagcttggggtcttcaggggcctacaattccttctctgttctgcggcacaaaatattttccagcggatcccccggtggcctcatgtcgcgcagtggaaccgatcctcagcaacgccagcaggcgtcagaggcggacgccgcagcagcaaccttccgggcaaacgaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggagaggtgaatccccagtacgatagcaccttcctgtttgacaacgacttcccagctctgcagcctgatgcccccagtccaggacccagtgatcatccccttttccaagcaaagtctgctcgaggagtctggctgcagagagactaagggcacttcctgaggttcattaccacctggggcagaaggacagggagacagcaaccatcgcctgaccacgccgaccacagggccttgaatccttttttgttttcaacagtcttgctgaattaagcagaaagggccttgaatcctggcctggaatttgggcagatatagcattaataaaactgtgcatctcaa

SEQ ID NO: 348251 - DNA, 383 bp, Homo sapiens
ctgtgtgtgtgggatctacagctctgttgtgttaaagtagaaactttagacaaattaaatctaacagtttaactgagcaaggaacaatccatgaagtacatagccctaagaatcagaagaggttcagaaagctccactccacaatgtggacagaaaatggaagttaaatacagaaacagcttgattggttgggatttgcatttgtctcacttggccgtggcctgattggttggccacctgtgattgactgaagcttggctactgtgattggctgagactcagctatttattttaaaagcatactgctgtgtagtgagctgagatcacgccactgcactccagcctgggtgacagagtgagactccattctcaaaaaaaaaaaa

SEQ ID NO: 348252 - DNA, 3613 bp, Homo sapiens
actccccatgctattaatttgttaaaggctttggtgttgtacagtactgaataactgccaatgccatctgcctgtggccttctcaagtttgtctgcacctgtggttatcctgacttcaaacccggggagacagaggctagaagaggcagacagctcttgtgtattctcctgtccagtgcaaagaacacctggaactctgagccctaaccttaaatgcaagacctcatctgcaggtgttcctcatccttttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttataca

SEQ ID NO: 348253 - DNA, 3198 bp, Homo sapiens
tgggcgtcagcgagccgtgagatgcgtggtccaccatcggtgacctcaccgcctcggttcgccctcagccgccccgattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttataca

SEQ ID NO: 348254 - DNA, 3038 bp, Homo sapiens
ggtcctcctgagccttccccctctgattctccctcccttcctgccctgggtggctccagcaaatggcccgtggagcctacaaccaggagtcacctcatggtttttttccctgtgagcaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttataca

SEQ ID NO: 348255 - DNA, 3334 bp, Homo sapiens
actccccatgctattaatttgttaaaggctttggtgttgtacagtactgaataactgccaatgccatctgcctgtggccttctcaagtttgtctgcacctgtggttatcctgacttcaaacccggggagacagaggctagaagaggcagacagctcttgtgtattctcctgtccagtgcaaagaacacctggaactctgagccctaaccttaaatgcaagacctcatctgcaggtgttcctcatccttttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctcccttccaaaagatgcagcatgaaggcatcatcttggaaacagacatgagccctcaacagacaactgcacctactgatgttttgatgttgaacttcccagcctccagaactctgggaaaataaagtcctctttataca

SEQ ID NO: 348256 - DNA, 2743 bp, Homo sapiens
tcgtaaccgttcgtacgagaatcgctgtcctctccttgcggccgccagtgtggtggaattccattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttataca

SEQ ID NO: 348257 - DNA, 3731 bp, Homo sapiens
actccccatgctattaatttgttaaaggctttggtgttgtacagtactgaataactgccaatgccatctgcctgtggccttctcaagtttgtctgcacctgtggttatcctgacttcaaacccggggagacagaggctagaagaggcagacagctcttgtgtattctcctgtccagtgcaaagaacacctggaactctgagccctaaccttaaatgcaagacctcatctgcaggtgttcctcatccttttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggaattctccattctaaaccagaactcatcaggcggctagagcaaggggaagtgccctggggagaagagagaagacgccggccaggcccctgtgcaggaatatatgcagaacatgtcctgcggcccaagaatcttggacttgcacatcagaggcaacagcaactacaattttctgatcaaagcttccagagtgacacagctgaaggtcaagagaaagaaaaaagcactaagcccatggcattttccagcccacccctaagacatgcagtaagctcaaggaggaggaacagtgtagtggaaatagagtctagtcaaggccagagggaaaatcctacagaaatagacaaagtattgaaaggaatagaaaattcaagatggggagcattcaagtgtgcagagcgtgggcaagacttcagccggaagatgatggtaatcatacacaaaaaagcacattccaggcagaaactttttacatgcagggagtgtcaccagggctttagagatgagtcagcattgctcttgcaccagaacacacacacaggagagaagtcctatgtgtgcagtgtgtgtgggcgaggcttcagcctcaaggccaacctcctcagacaccagaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcactttacaccagaggacacactcagaggagaagccttatggatgtcgggagtgtgggcgaaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggagaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccaaggcaggcctgttacactctccccaacctccttggactgcaaacaatctaggacacctccaccaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtgattaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttatacatttcctagtcagtggtattttattataacagctcaaatagactaagtaactgctcccctcatcattctctcacagtcatatctggaaataaaatctctgtatatgcaaaaaaaaaaaa

SEQ ID NO: 348258 - DNA, 791 bp, Homo sapiens
actccccatgctattaatttgttaaaggctttggtgttgtacagtactgaataactgccaatgccatctgcctgtggccttctcaagtttgtctgcacctgtggttatcctgacttcaaacccggggagacagaggctagaagaggcagacagctcttgtgtattctcctgtccagtgcaaagaacacctggaactctgagccctaaccttaaatgcaagacctcatctgcaggtgttcctcatccttttagcccctcagtgatgtaagcaacaaacgtcacccagctcctggggcacacttcactcccagatgagcttgtcctggatttgcagggagcctggctccctagaccttttggccagatccccacaggggaattgtgcaggtgcgccctccccagatccccagttggtattggaatcacaccaactgtcacacatggggagggcagctgcacccagccaccctctgacttctctcctcccacagattggccatctgcaagcttcccttctccgtggagagcaggaagacagtcatgggacctcagggagccaggagacaggctttcttggcatttggggatgtcactgtggatttcacccagaaggaatggaggctgctgagccctgctcagagggccctgtacagggaggtgacactggagaactacagccacctggtctcactaggtaagcgtggcttccctcgagcctaacatttggcctgtggtgcctctgatgttgccatagggttaggttcagagacaagaatgttgttttctctatt

SEQ ID NO: 348259 - DNA, 582 bp, Homo sapiens
  misc_feature (569)..(569): n is a, c, g, or t
tgagactaacagtgaaatggtaataattacctctggatattttggtttatttcagggtgtaccttctaatgaaatacttaacatattgtccagcattcctgaagctgaaaaatttgctaaattctggatctgcaaagcaaagttgttggcaagtaaaggcacctttgatgttattgggctatatgaagaggccattaaaaatggggcaacagtgagtatctgtcttgggtgggtaacttcttaaaattctctttcatgtgagttctctgttgttgtttgtaatatgatggttagaagtttgcaacatcaatatccaacacttataaagtcataccttaccataaagaacttaaaaataaaacacctcatattcctaaaatcaggaatgaaagtgaggcttttaccatacagaaattgaacagtatcttaagggaataacatgaacaaatgtgtgtaccattacttgtatgctcataggaagtctagacaaatggacaagctcctagaaagatacaaacaattgaacttgactcaagaagcagcagtaaccttagctatggagagacggnggatccgctagag

SEQ ID NO: 348260 - DNA, 3217 bp, Homo sapiens
tgaagaaaaactgtcactgaagagtcatggtggggcccgggcctaccgctgctgccgctgtcgaagagcggcagagaaagcttcaggagtaccttgcagccaagggaaaactgaagagccaaaacaccaagccttatctaaaatccaagaataattgccagaatcaaccaccttctaaatctactattagacccaaaaatgatgttaccaaccatgttgttttgcctgtcaaacctaaaaggtccatcagcattaaactccagcccagaccacctaatactgcagggtcccagaagccgaagttggagccaccaaaacttctgggcaaaaggctgacttcagaatgtgtttcttctaacccatactctaagccttctagcaagagttttcaacagtgtgaagctggatcgtccacaacaggagaactgtcaagaaaacctgtggggtcacttaatatagagcaattgaaaactacaaagcagcagttaacagatcaaggaaatggtaaatgtatagactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttgttggagaaacacaaagcaggactttcccagtgaaatcacagcaactctctagtggagcagatcttgcaagaccaggagtaaaaccctcaaggacggttccctctcactttattcggacccttagtaaagttcagtcatcaaagaaaccagtagtcaagaacatcaaagatataaaggttaataggagtcaatatgaaagaccaaatgaaactaagatacggtcataccctgttactgaacagagagtgaagcacaccaaacccagaacataccccagtttgcttcagggtgaatataacaacagacatccaaacatcaagcaagatcagaagtccagccaagtttgtatacctcagacatcatgtgtactgcaaaagtcaaaagccataagccagaggcctaatttgacagttggcagatttaattcagccattccaagcacccctagcataagaccaaatggaaccagtggtaataaacataacaataatggctttcagcaaaaagcacagactttggactccaagttgaaaaaggctgttccccagaaccattttctgaacaagacagctcccaaaactcaagctgatgtcacaaccgtaaatgggacccaaacaaacccaaatattaaaaagaaggcaacagcagaggatcgaaggaaacaactagaagaatggcagaaatctaagggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgttattgggctatatgaagaggccattaaaaatggggcaacaccaatacaagagttgcggaaagttgttcttaatatcttgcaagactcaaacagaaccacagaagggattacttctgactcttcagttgctgaaactagtataacatcagtggaagagctggccaagaagatggaatctgtgaagtcttgtctttctccaaaagagagggaacaagtcacggcgacaccccgaatagccaaggcagaacagcataattatcctggtatcaaattacagattggtccaatccctagaataaatgggatgccggaagtgcaagacatgaaatttatcactcctgtacggcgttcgtcgaggattgagcgagcagtgtcccgctacccagaaatgctgcaggaacacgatttagtagtggcttctcttgatgaactgttagaagtggaagaaacaaaatgttttatattccgtagaaatgaggcgctgcctgtaacattggggtttcaaacccctgaatcataatttcttgatgctttttttaaaaaaggtgtttcagaaccaacataagacaagaaatattcttgtccaagtgacctggaaaaaaagagaggcatcatggatgcagattatggacgctcaggacttaagtaattcactgggcttactctcaaattttctctccccatgggaaaatctttgctttatgtgtttaagaccagtttgccagttttacagtatacataaatttcaaacttttgaatatttaccctacaactatgataaatatttatactttattgatctactttaatcccaacatagttttttatatcagaaggttggtcccacaatataatgggacttttctttctgcatccaccttagcagagggcaagttctttcatcgtggaagatctgaactttgacgctagcttgacaggctgaatggaccttgacagatggccaagtcaaaacccctcattttacagatgagtttatgctagctgtgcctttgctcagagatcataaatttatgtgtgatctttgactttcatcacagtatccttgtaaatgagagagaattcttgttttttctatgccaggtctcctcagatgaaacacaatcctgaattggcgtggtcgtctagcttttatattcaaacctagttttgcatttgttactcagaaacacttcaagtaacaaaaggggggcaggggagaggggtggggagtggacacttgcttcttcagttctttgctcagctagggtatagctggcctgagaaggcagtgcaagccccagagactgttgtaggttgctttttcttcctcctgggcaactatttgtggaaaggttttaccttagtcattatgtaaatataattgtgtagaaaaacctagtcaacacattttaaattttagctttcttaatatttaagtattatcttaaaacaacattaaatttctattagttc

SEQ ID NO: 348261 - DNA, 1978 bp, Homo sapiens
tgaagaaaaactgtcactgaagagtcatggtggggcccgggcctaccgctgctgccgctgtcgaagagcggcagagaaagcttcaggagtaccttgcagccaagggaaaactgaagagccaaaacaccaagccttatctaaaatccaagaataattgccagaatcaaccaccttctaaatctactattagacccaaaaatgatgttaccaaccatgttgttttgcctgtcaaacctaaaaggtccatcagcattaaactccagcccagaccacctaatactgcagggtcccagaagccgaagttggagccaccaaaacttctgggcaaaaggctgacttcagaatgtgtttcttctaacccatactctaagccttctagcaagagttttcaacagtgtgaagctggatcgtccacaacaggagaactgtcaagaaaacctgtggggtcacttaatatagagcaattgaaaactacaaagcagcagttaacagatcaaggaaatggtaaatgtatagactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttgttggagaaacacaaagcaggactttcccagtgaaatcacagcaactctctagtggagcagatcttgcaagaccaggagtaaaaccctcaaggacggttccctctcactttattcggacccttagtaaagttcagtcatcaaagaaaccagtagtcaagaacatcaaagatataaaggttaataggagtcaatatgaaagaccaaatgaaactaagatacggtcataccctgttactgaacagagagtgaagcacaccaaacccagaacataccccagtttgcttcagggtgaatataacaacagacatccaaacatcaagcaagatcagaagtccagccaagtttgtatacctcagacatcatgtgtactgcaaaagtcaaaagccataagccagaggcctaatttgacagttggcagatttaattcagccattccaagcacccctagcataagaccaaatggaaccagtggtaataaacataacaataatggctttcagcaaaaagcacagactttggactccaagttgaaaaaggctgttccccagaaccattttctgaacaagacagctcccaaaactcaagctgatgtcacaaccgtaaatgggacccaaacaaacccaaatattaaaaagaaggcaacagcagaggatcgaaggaaacaactagaagaatggcagaaatctaagggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgttattgggctatatgaagaggccattaaaaatggggcaacaccaatacaagagttgcggaaagttgttcttaatatcttgcaagactcaaacagaaccacagaagggattacttctgactcttcagttgctgaaactagtataacatcaaaggtgcctttactcgccaacaactttgctttgcagatccagagtttagcaaatatttcagcttcaggcagttctctctccctgta

SEQ ID NO: 348262 - DNA, 322 bp, Homo sapiens
gaatcttggtgtctgccttctcgtgggtgggcgcaacccaatgctgccattacccatttgtaaattgttttttaattccattctcctgattttgtctgtagttgaaagtatttaattatactctatctatacatatcatatactttagcagcttgactatgtttaaaaataaataaaaccactctccctttaattgaatttcaggaaacaactagaagaatggcagaaatctaagggaaaaacctataaacggcctcctatggaacttaaaacaaaaagaaaagtaataaaggaaatgaatatttcattctggaagagcatt

SEQ ID NO: 348263 - DNA, 382 bp, Homo sapiens
tttaaatgataaggtttttaatgcatctcttgctgtctctcagaataaatgggatgccggaagtgcaagacatgaaatttatcactcctgtacggcgttcgtcgaggattgagcgagcagtgtcccgctacccagaaatgctgcaggaacacgatttagtagtggcttctcttgatgaactgttagaagtggaagaaacaaaatgttttatattccgtagaaatgaggcgctgcctgtaacattggggtttcaaacccctgaatcataatttcttgatgctttttttaaaaaaggtgtttcagaaccaacataagacaagaaatattcttgtccaagtgacctggaaaaaaagagaggcatcatggatgcagattatggacg

SEQ ID NO: 348264 - DNA, 2123 bp, Homo sapiens
tgaagaaaaactgtcactgaagagtcatggtggggcccgggcctaccgctgctgccgctgtcgaagagcggcagagaaagcttcaggagtaccttgcagccaagggaaaactgaagagccaaaacaccaagccttatctaaaatccaagaataattgccagaatcaaccaccttctaaatctactattagacccaaaaatgatgttaccaaccatgttgttttgcctgtcaaacctaaaaggtccatcagcattaaactccagcccagaccacctaatactgcagggtcccagaagccgaagttggagccaccaaaacttctgggcaaaaggctgacttcagaatgtgtttcttctaacccatactctaagccttctagcaagagttttcaacagtgtgaagctggatcgtccacaacaggagaactgtcaagaaaacctgtggggtcacttaatatagagcaattgaaaactacaaagcagcagttaacagatcaaggaaatggtaaatgtatagactttatgaataatatccatgttgaaaacgaatctttggataactttctaaaagaaacaaacaaagagaacttgctcgatatcttaacagaacctgagaggaagccagatcctaaattatataccagaagtaagccaaagactgactcttataatcaaaccaagaacagtttagttcctaaacaagccttgggcaaaagttcagttaatagtgctgttctgaaagatagggttaataaacaatttgttggagaaacacaaagcaggactttcccagtgaaatcacagcaactctctagtggagcagatcttgcaagaccaggagtaaaaccctcaaggacggttccctctcactttattcggacccttagtaaagttcagtcatcaaagaaaccagtagtcaagaacatcaaagatataaaggttaataggagtcaatatgaaagaccaaatgaaactaagatacggtcataccctgttactgaacagagagtgaagcacaccaaacccagaacataccccagtttgcttcagggtgaatataacaacagacatccaaacatcaagcaagatcagaagtccagccaagtttgtatacctcagacatcatgtgtactgcaaaagtcaaaagccataagccagaggcctaatttgacagttggcagatttaattcagccattccaagcacccctagcataagaccaaatggaaccagtggtaataaacataacaataatggctttcagcaaaaagcacagactttggactccaagttgaaaaaggctgttccccagaaccattttctgaacaagacagctcccaaaactcaagctgatgtcacaaccgtaaatgggacccaaacaaacccaaatattaaaaagaaggcaacagcagaggatcgaaggaaacaactagaagaatggcagaaatctaagggaaaaacctataaacggcctcctatggaacttaaaacaaaaagaaaagtaataaaggaaatgaatatttcattctggaagagcattgaaaaagaagaggaagaaaagaaagcacaactcgaactgtccagtaaaattaacaacactctgacagaatgtctgaacctcatcgaagggggtgtaccttctaatgaaatacttaacatattgtccagcattcctgaagctgaaaaatttgctaaattctggatctgcaaagcaaagttgttggcaagtaaaggcacctttgatgttattgggctatatgaagaggccattaaaaatggggcaacaccaatacaagagttgcggaaagttgttcttaatatcttgcaagactcaaacagaaccacagaaggtactattatttttgaatttaaattcatcttctctagctgtaccagtaaaaatcatccaggacatataggaaaaagaagaaaagaatcatcccctgaaatgcttctcacttcttggtttccatgacctggccctttcagccattgtcatcagctgacttatttgtattattacaagtaaatgcactactcaatactgaacaaaggttgtttccaccaaaacagcctagactggagtgtcccacttccttggaatcctagatggcagaagacaaac

SEQ ID NO: 348265 - DNA, 1850 bp, Homo sapiens
tataatattatatgaacaacagataggagagttcttttacaaccagaaaggacttagagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggcgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgctttaaaaaaaaaaaaaacttctattatttgtttagtatgttgtaagtagatcattttaaaaaactgaatctatattatgtttaacttcagaaggcatcatttataagacagtatggcagttaattataaaattattttgatgaattatgatacaatctacataataaagaatccttttgattatttaggatattttgtc

SEQ ID NO: 348266 - DNA, 1557 bp, Homo sapiens
ggtttggcaagagaccaacctcagctcagactttccatctgagcacagccgtttggctatgagctttttactgaattttatagcaactctgatttcttcctttaaatgattggaggctttttaaagatcttatggggctcaaatactaacttcataaatggccttttgaataacagcagcaaataatctctcagctgatatttcaatttactaaggaagcacaaattaaaacattcctgctacacagtcatgggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggcgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgctttaaaaaaaaaaaaaacttctattatttgtttagtatgttgtaagtagatcattttaaaaaactgaatctatattatgtttaacttcagaaggcatcatttataagacagtatggcagttaattataaaattattttgatgaattatgatacaatctacataataaagaatccttttgattatttaggatattttgtc

SEQ ID NO: 348267 - DNA, 1270 bp, Homo sapiens
agcgcctgcgcgacgcctggctgctgggccccggggcagttcagcccgcgccgctcctgcgggtcggactggggctgtggcgggagagaagatgccgcagcccgagtcccagaaggcggcgatcctgggctgcgggcaaggcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccattaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggcgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgctttaaaaaaaaaaaaaacttctattatttgtttagtatgttgtaagtagatcattttaaaaaactgaatctatattatgtttaacttcagaaggcatcatttataagacagtatggcagttaattataaaattattttgatgaattatgatacaatctacataataaagaatccttttgattatttaggatattttgtc

SEQ ID NO: 348268 - DNA, 920 bp, Homo sapiens
agcgcctgcgcgacgcctggctgctgggccccggggcagttcagcccgcgccgctcctgcgggtcggactggggctgtggcgggagagaagatgccgcagcccgagtcccagaaggcggcgatcctgggctgcgggcaaggcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtaagtatatgatgtttaccagcatccatatcaatgtatttaatcactggaagtttgattaattagttaattaggagatcagaaatgctgcatcattttttccccactgatttattttgtttgtgaactacctgaagttctgtggtttctgcagactcagtggggagttatattctaatttatccagttctgacttcagtatcttatgagaaaacaaacaaggtccagggaagaaaaattaaaaggctagaaagaaaatggaacctatgggagaaggggtttgttttttgtttgtttttttaagagatggggtctcaccatattgcccaggctgtccccgaattcttgggctcaagctgccctcccacctcaaccttgagagtagctgggactataggcatgcaccactgtgcccagccctggaagaaggttttaattgctaga

SEQ ID NO: 348269 - DNA, 332 bp, Homo sapiens
gaaaagaactttcgagacttagaaaagtagccttcgtatgccagatactagcatattattagcaatctagaaaattcagttgtatggcctggctcattctctgatactggataaaatgattcataatcattaattcaatttttattagttatgttccaaaatgacactgagtattttaaacaaaagtagtaggtaagataactgactataaggaatgagtacagtaattttcctttttctaggtcaccaacaatggctggaggtttgtttgccatgaacagacagtatttccatgaacttggacagtatgatagtggcatggatatctgggg

SEQ ID NO: 348270 - DNA, 146 bp, Homo sapiens
caccaacaatggctggaggtttgtttgccatgaacagacagtatttccatgaacttggacagtatgatagtggcatggatatctggggaggagaaaatttggaaatatcatttcgggtaatttaatttttgcatgctcaattaata

SEQ ID NO: 348271 - DNA, 2626 bp, Homo sapiens
agcgcctgcgcgacgcctggctgctgggccccggggcagttcagcccgcgccgctcctgcgggtcggactggggctgtggcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggcgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgctttaaaaaaaaaaaaaacttctattatttgtttagtatgttgtaagtagatcattttaaaaaactgaatctatattatgtttaacttcagaaggcatcatttataagacagtatggcagttaattataaaattattttgatgaattatgatacaatctacataataaagaatccttttgattatttaggatattttgtc

SEQ ID NO: 348272 - DNA, 1684 bp, Homo sapiens
acgttctgtaccctaacaaccttccgtcacttccttccctagctcagaaagggggacaagatcccatttgaagtgcagtccccagttgaaccctccgcggacgacaggggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggcgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgctttaaaaaaaaaaaaaacttctattatttgtttagtatgttgtaagtagatcattttaaaaaactgaatctatattatgtttaacttcagaaggcatcatttataagacagtatggcagttaattataaaattattttgatgaattatgatacaatctacataataaagaatccttttgattatttaggatattttgtc

SEQ ID NO: 348273 - DNA, 1973 bp, Homo sapiens
agcgcctgcgcgacgcctggctgctgggccccggggcagttcagcccgcgccgctcctgcgggtcggactggggctgtggcgggagagaagatgccgcagcccgagtcccagaaggcggcgatcctgggctgcgggcaaggcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtgtggcctcatgagcagtttcataggcttgatgaaagtgaaagccaaactgacctgaataaagagtgaaaggaaaatgagcaaaaggagatagtcaatgtggaaaatccttgagaaaaatttgccaagaaaggaggagatggcttgatagctagtgcggtggcctcatgaggcca

SEQ ID NO: 348274 - DNA, 377 bp, Homo sapiens
tttttcattgcagaggtggtgtggagctggcagctgctgtgggagcttctggagtcaatgggtggctgctgcaccctgcagctccctcaccattgcaggatggagctctcttggtgacctggtttccctatggctttgagcgtttttcttgtgtgttcatcctggaatttgtttctttactgatatggtttggctgtgtccccacctaaatctcatcttgaattcccatgtgttgtggaagggacccagtgggaggtaattgaatcatgagggcaggtctttctcatgctgttcttgtgctagtgaataagtctcacgagatctgatggttttattttattttattttatttttatttttgagatgaagtctcactc

SEQ ID NO: 348275 - DNA, 354 bp, Homo sapiens
tcagagctttttttttttagatttactcatcttattccattcttttgtgtttaatttccttcttatcagaacatatattgagtagttatttcagcagctatctgtgattgttgaatttccccagactttgttggaaatacctttattcatttgtattcttgtataatttaattaggtgaacaaattattttatcttctaaaatttgttacttccttttttcccttcaattttgaaacattttcagccaatatctcttcacatcttgcctcttgtctattctctctgttgtctccttctggaattcttttctctctctgtctccccctacccgcccccgagttggagtctcactc

SEQ ID NO: 348276 - DNA, 527 bp, Homo sapiens
actgaagccttgttttattaagttagtatcttaaccttgcttcttgcttttcatttcaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348277 - DNA, 295 bp, Homo sapiens
tgaacttcttatccagaaaatcaccacagcatttgtgcattcatctgatagccatcttccctgaaggacattgcatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348278 - DNA, 1818 bp, Homo sapiens
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaaaaaaaaaaaaaaaaaaaaaaaaaaaaaaaaaaaaaaaaaaaaaaaaaaaaaaaaaaaaaaaaaaaaaaggaggggggggggaaaaaaccggggggacccaaagtcgaacgtccgacatataataatgtaaagagggcgccaaaagagagaaggctaaaaacacgaggaaggccggctcaacagacaagggtagagcgacaaagactgcggggagtttaggggagacccaccactgctggtggtgacatcgacgaaacaccaccaatgagagaagcgagcaaaaaaaccgggttgcgggccaccctatcagtggaacaatggctcgcgttttaaattggacgactctgcaaaagcgggcagacatacaccgccgtgcagacaacgtcgacgtagtcatgagcacagataacgagaaccccacac

SEQ ID NO: 348279 - DNA, 1421 bp, Homo sapiens
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaaaaacaagcttaagaattcacacaggt

SEQ ID NO: 348280 - DNA, 2159 bp, Homo sapiens
  misc_feature (988)..(988): n is a, c, g, or t
  misc_feature (1430)..(1430): n is a, c, g, or t
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgaggtaagagttactgacctttgtctgatcccagagggcccgttcttagtcatcaaagtggtatttagttgagcaaaagtgcaatatctgcttctctgtgtcagtgcagttaattgtgactttggacaagcatatttctctaaactgcctccatccataggtgggcattcattctttctctttgacctctgttacctgttcatcctgctggtctcatgagatttgactggaaaacataaaagtgagctatagttgtaaacaaaattatcttgcantgaggcagaggaatttagcaaattctcatccagccagaggaatgggagatttccatgaacgctgaaggtaggagactcggaggagtcttgtaaacacaggaggaggtcatgaaggcttttctctttattcctgccaaatctgtaattcccacttgttgtgatattgcagcatgtgctcagtcacccaacctaatctctaagactgcggctggtttacagccctgaactcactgtccagaatacaagattcaaaccagggttgacccataggtctcactggttggtcttccatccactgccattcagacggatgccctggatgaatctggtgcggaagaccagggaagtggcaggacaaggaggcactgctggtggtggctgtggaaacacccagcctgacagaaggctttatctcagagtcagactgtcttgcccatgcttnagtcatgctgctttggcacatttaatgattttgtgtttccatttctgtagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348281 - DNA, 1398 bp, Homo sapiens
ggataccgctgtccaggcgaaggtcgccgccgttggaagaccctccttccctattgtctaggtggcaacaggattttgctttgctggttttccggtgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348282 - DNA, 1341 bp, Homo sapiens
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaacaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348283 - DNA, 1671 bp, Homo sapiens
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggtgagtttactagttactgtgcttttatttgctgtacttctaaagaagtttgtgcttctcattaagccattgtaaatggagtcttcaagatcttgatgtgcttctattctttcttcattgcaaggtgttagttattagtatagtaactttctcaaagtgcttattcattgaccatgggctgaggttgtttgtcatcgtccgttcaggaagctgccaggcagaactatgtggatttggtgtccagtttgagtccttcattggaatcctctagtcaggtggagcctgcccacggagtttgtcctgttttactttcttcttctatgtgtttcacacaaaagctgtagagtttcagcatcattcctattttaagatatctcttgtttgatttgtgcaggaaggttggtaattgtggctacttcatacaacagagttgagcattcattgtttagagtttgtgaatttcagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348284 - DNA, 798 bp, Homo sapiens
  misc_feature (723)..(723): n is a, c, g, or t
  misc_feature (729)..(730): n is a, c, g, or t
  misc_feature (732)..(732): n is a, c, g, or t
  misc_feature (740)..(741): n is a, c, g, or t
  misc_feature (744)..(745): n is a, c, g, or t
  misc_feature (751)..(751): n is a, c, g, or t
  misc_feature (753)..(753): n is a, c, g, or t
  misc_feature (762)..(762): n is a, c, g, or t
  misc_feature (765)..(766): n is a, c, g, or t
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgaggaattgngggcgnnanagaattcnnaannctgatngngggcaaggnccnngggggctccaccccctgggaatgaacccgtta

SEQ ID NO: 348285 - DNA, 974 bp, Homo sapiens
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaaaaaaaaaaaaaaaaaaaaatctttttgggcgggcggagccgaaaaagtttttaaacacccttctttgggggcgcgggcccctttggtgttggaacatgggccaagcgggtccaaagggaatcccgggccatacaatggggggcgtggttcccccaaataaaaaagcgcgggtcgacccgagggtttcttgaacacacctcccaggtggggtggggggcacaccgcgggccttcacacaggggggccaacgcagccgattaacgcgcgcccggggtgatagtagaagacccgagagaatcacaaaacaacagagtacaacagctacaaagaggaagaagacaacaagcagagacgatacaagccaaatagacagaacctgacacagagaaacaacagtcaagagaaacaaccgaccaagaagacgcgacgtgaaaacagcatgacaaacgacat

SEQ ID NO: 348286 - DNA, 402 bp, Homo sapiens
ttcatgtacttacagattttatggatcttaaatatttaggggtctagtttacatggacatttgaacatattgcccctctccttttcacaggccactgaaggaccttgtaacatgcccaaaccaggtgtatttgacttgatcaacaaggccaaatgggacgcatggaatgcccttggcagcctgcccaaggtgagtttactagttactgtgcttttatttgctgtacttctaaagaagtttgtgcttctcattaagccattgtaaatggagtcttcaagatcttgatgtgcttctattctttcttcattgcaaggtgttagttattagtatagtaactttctcaaagtgcttattcattgaccatgggctgaggttgtttgtcatcgtccgttcaggaagctg

SEQ ID NO: 348287 - DNA, 1395 bp, Homo sapiens
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348288 - DNA, 1653 bp, Homo sapiens
ggataccgctgtccaggcgaaggtcgccgccgttggaagaccctccttccctattgtctaggtggcaacaggattttgctttgctggttttccggtgaggtagtgctaaaaagtgacgacctcacgcgcgccctcctgcaccgctgggcccggagtggtcaggatgggcgcgtcgggaggtcagggctatggttccctgtcagcagtccccaaggtctccgcctgcctccgcgcacgctcccatcctcctggggccggactccgggcgggtgagccgccccagctgagcacccgggcctgcacttcccagccgggctgcttctggggtgcaaagcgtcgcttgctaaaagcgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348289 - DNA, 1601 bp, Homo sapiens
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggtgagtttactagttactgtgcttttatttgctgtacttctaaagaagtttgtgcttctcattaagccattgtaaatggagtcttcaagatcttgatgtgcttctattctttcttcattgcaaggtgttagttattagtatagtaactttctcaaagtgcttattcattgaccatgggctgaggttgtttgtcatcgtccgttcaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348290 - DNA, 1466 bp, Homo sapiens
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgaggaaggttggtaattgtggctacttcatacaacagagttgagcattcattgtttagagtttgtgaatttcagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaa

SEQ ID NO: 348291 - DNA, 859 bp, Homo sapiens
acccccgagcccccgcagccctagcagccctagagccgcccaagggatggcgatggcgtacttggcttggagactggcgcggcgttcgtgtccgagtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggtgagtttactagttactgtgcttttatttgctgtacttctaaagaagtttgtgcttctcattaagccattgtaaatggagtcttcaagatcttgatgtgcttctattctttcttcattgcaaggtgttagttattagtatagtaactttctcaaagtgcttattcattgaccatgggctgaggttgtttgtcatcgtccgttcaggaagctgccaggcagaactatgtggatttggtgtccagtttgagtccttcattggaatcctctagtcaggtggagcctgcccacggagtttgtcctgttttactttcttcttctatgtgtttcacacaaaagctgtagagtttcagcatcattcctattttaagatatctcttgtttgatttgtgcaggaaggttggtaattgtggctacttcatacaacagagttgagcattcattgtttagagtttgtgaatttcaggtaggttctgatatacccagaaggcactgtgattttccta

SEQ ID NO: 348292 - DNA, 3132 bp, Homo sapiens
  misc_feature (384)..(384): n is a, c, g, or t
  misc_feature (635)..(635): n is a, c, g, or t
ttaactccttacttgaaacatttagactatctagatgtttagaagtgcccgatgtatattaaatgtagaggtagtaaaataccaatttgtaaatatctttttgctaaaattcataggaaatacttttggaagttgaattgtgaagccacctttgtgagcagtatattactgtctatacttgctcaatggtttagaggaggtgggagggaagaaattgcaaaagataatatgctagtgtgttcatacttggacattttcagacaccatttttctgtatgttttgtgcattttgttttgctctgtatatagtgtatataatggacaaatagtcttaattttttaacatctagaggttgccagtgtatgacaaagtagtaaaattancatattttgtatgctttgtgttgaaattcataggaaaacttgtcttctgtaattgacttttgcataggaatttgttcagccatctctaagcattacacatgcgtgtacttgtccactgaattgaaggcagagaaggaagagaagagggaatgattcaaggccaaaatggtcacatttagaagataccttagatgataaccattgttatgtgtgtgcagtttatttaacagtgccgtgtacatggtggacangctatgaaatatctagtctttagatgtttggaagtgcttgatgtattttaaagtagtagtagtagaataacactttttgtaaatagcttttaaaaactgatgggaaatgctgtttggaagtggatttgttgaaccacctgggaggtgggagggaaaaaattgcaaaaggtgttttgccattgtttattagaaaatttcagcttaatccattgcctatatgttacaagcatttcatttaactttgctatactgtatatattgtgtatatactggacaaatgagtcctgattttataatatctagtctgtagctattaaagaggttgccagtgtatgacaaaagtagttagtaaactaacgcattttgtacactttgttaaaattcatagagaggctgtcttctgaaaaggactttttggaagtgaaatgataacatcagctcgaagtgacacatgtgcttatatccaccaggttggtggtggagaggagttggaaggaatgaagggttctagaccagaatgttcctatttagaagacactttcagatataaccattgttacatgtgtgtagtttattcaacagtgctatgtatatagtggacacacttaagtccttatttgaaatatctagtctttctagatgtttagaagtgcacaaagcatgttaaaagtagaggtagtaagtaacacattttgtagttattttgatatgaaatattgtcttggaaattgatcaattctctgagaagtacacgttatgatatttgtgctggttcagggggaagaaggagcacaaagttcaaagggctttctaccagtgtccagtgtgtttatgatgaggcacattgaccattgtcccttatgtctgcattttcgtttactgtgctgtgtatataagcagacataggagtcctaatttatatctagtcgatgttaaagaggttgccagtgtatggcaaaagtagagttagtaaactaatacattgagtacactttgtgttaaaattcataaggaacacttcttaaaaacagaagtaaaattgttaaacgccccccgcccccaagcattacagatggcttatagctgtcaacggggttggtagaggtcagaaagggaagtgttctaggccagaatgttcctatttagaagacactcaaattatagtctatgttatgtatatatgccatttattcaatactactgtgtatataatggaaaacttaagtgcagtttgaaacatctagtctttctaggtgtttaaaagtgcacaatggtcaggtgcggtggctcactcctgtaatcctggcactttgggaggctgaggtgggcagatcacgaagtcaagggatcgagactatcttggccaacatggtgaaaccccatctctacaaaaaatacaaaaattagctggtcgtggtggcacatgcctgtagtcccagctactcgggaggctgaggcaggagaatcgcttgagcccgggagacagaggttgcagtaagccgagaccacaccactgcactccagcatggcgacagagcaagactccatctcaaaaaaaaaaaaaaaaaaaaaaaattccacaacataggttaaaagtagagggctaaagtaacacccctctaagcatttgttttcagtacttcctaggagtggttgcatttgggaatggaattgttaaaacttgatgcttaggagcgtatgctgactattcactgcgtggtggggtggggaggaggaggaggtatgcagggagaagggttctgtgcccctgagttagattagttcagatggtctaaccattgttctatgtatgcattttattgtgttaatattgtgtattaaaggataaacaagtcttaatgctcaaagtatgttaaaaatagatgtagtgaatcagtccctttgtgaatgtcctattgttagtttttaggaaggcctgtcttctgggagtgacctttattagtccacttcttggagctagacgtcctatacttagtcactggggatggtgaaagagggagaagaggaagggcgaagggaagggctctttgctagtatctccatttctagaagatggttttagatgataaccacaggtctatatgagcatttttagtaaagtgcctgtgtttattgtggacagagtttattattttgcaacatctaacctttatgaatatctgaggtgacaatgtgtgataaaaactagagctagtgggccaggcgcggtggctcatgcctgtaatcccaacattttgggaggctgaggcaggcagatcacaaggtcaagagatcgagaccatcctggtcaacatggtgaaaccccatctctactaaaaatacaaaaattagctgggcgtggtggcgcgtgcctgtagtcccagcttctcaggaggctgaggcaggagaatcacttgaacctgggaggcggaggttgcagtgagccaatattgcgccactgcactccagcctgggcaacacagcaagactccatctc

SEQ ID NO: 348293 - DNA, 1193 bp, Homo sapiens
  misc_feature (70)..(70): n is a, c, g, or t
tggccaccccccccctccccctcccccccccgcacatcctctactcgcttttgcgccccgccggttccanttcaatgataaccggccatggctgatcctgggaacagaggagggatccaccgccccttgagcttcacctgctccctgctcattgtgggaatgtgctgtgtatctcctttcttctgccatagccagacagacttgctggctcttagccaagctgatcctcagtgctgggaatcctcctcagtgcttctcctggaaatgtggaaacctcgcgtttccaacactgtttcaggcttctgggattttatgatctacctgaagtcatctgagaacttgaagcatggagcactgttttgggatctggcccaactcttctgggacatctatgtggactgtgtgctctctaggaaccatggcttaggaaggaggcaattggttggagaggaagagaaaatctcagcagcgcagccacagcacacaaggagtaaacaaggtacatattctcagctcctaaggacctccttcctaaagaagaaagagttgattgaagatttgataagcatgcatgtgcgtaggagtgggtctagtgtcattggaaaagtgaacctggaaataaagagaaaataaattgaactcggagctaattcatgccttggaattaaatatacatatatataacatttttcttaactattgattatttatttattttaaatggtgggaatgcccagagataaatatgaacccaaattctctcagtatactaatttaaagctgccttctattatttatttatttattttaggctgctagcatgtttcttctaatggtgacattactgccagtctatcccacagtctaaaggagttaaataacttccagagatgacttgaggattctttgtattcatttaatagttcattttgggatgcttgacatgttaataaactagtgtgccatacatttaacttgaatacactgcatggcttccaagacttcaaccactggattgcttatgcacaggcacataagggactacattttggaattactagttactgacaatctatgatatctgaatcttgtttgacagcatatttttgaatactgaatgaagcaaaaagtaaaacaaaacaaaaaactggcaaataaagcattcttctaatgaaaacaaaattaataaaagc

SEQ ID NO: 348294 - DNA, 1014 bp, Homo sapiens
ccaggaactcctaggtactgaaggaacaaaagtaaattcttggcttaaagttgctcacaatttagcaggaagagacatgtttaaaaaaaaaatttctagacccaaggtgatgagtaaacaaagctactcttgtgctgggagtaaaaagaagagcactgatgggcaggtgggcgagggatgcagaagcctttccaaaagaagtgagttttgaactatattgaaacatgacaagaattcaccagtctaacaaaatgggaaacgtattcaaggcacaggaagcaacaagtgcaagacccaggaggaggcacccagacccttgggtacatattctcagctcctaaggacctccttcctaaagaagaaagagttgattgaagatttgataagcatgcatgtgcgtaggagtgggtctagtgtcattggaaaagtgaacctggaaataaagagaaaataaattgaactcggagctaattcatgccttggaattaaatatacatatatataacatttttcttaactattgattatttatttattttaaatggtgggaatgcccagagataaatatgaacccaaattctctcagtatactaatttaaagctgccttctattatttatttatttattttaggctgctagcatgtttcttctaatggtgacattactgccagtctatcccacagtctaaaggagttaaataacttccagagatgacttgaggattctttgtattcatttaatagttcattttgggatgcttgacatgttaataaactagtgtgccatacatttaacttgaatacactgcatggcttccaagacttcaaccactggattgcttatgcacaggcacataagggactacattttggaattactagttactgacaatctatgatatctgaatcttgtttgacagcatatttttgaatactgaatgaagcaaaaagtaaaacaaaacaaaaaactggcaaataaagcattcttctaatgaaaacaaaattaataaaagc

SEQ ID NO: 348295 - DNA, 721 bp, Homo sapiens
tggtaacaaaagaacaatttcaaagtggtacatattctcagctcctaaggacctccttcctaaagaagaaagagttgattgaagatttgataagcatgcatgtgcgtaggagtgggtctagtgtcattggaaaagtgaacctggaaataaagagaaaataaattgaactcggagctaattcatgccttggaattaaatatacatatatataacatttttcttaactattgattatttatttattttaaatggtgggaatgcccagagataaatatgaacccaaattctctcagtatactaatttaaagctgccttctattatttatttatttattttaggctgctagcatgtttcttctaatggtgacattactgccagtctatcccacagtctaaaggagttaaataacttccagagatgacttgaggattctttgtattcatttaatagttcattttgggatgcttgacatgttaataaactagtgtgccatacatttaacttgaatacactgcatggcttccaagacttcaaccactggattgcttatgcacaggcacataagggactacattttggaattactagttactgacaatctatgatatctgaatcttgtttgacagcatatttttgaatactgaatgaagcaaaaagtaaaacaaaacaaaaaactggcaaataaagcattcttctaatgaaaacaaaattaataaaagc

SEQ ID NO: 348296 - DNA, 469 bp, Homo sapiens
ccaggaactcctaggtactgaaggaacaaaagtaaattcttggcttaaagttgctcacaatttagcaggaagagacatgtttaaaaaaaaaatttctagacccaaggtgatgagtaaacaaagctactcttgtgctgggagtaaaaagaagagcactgatgggcaggtgggcgagggatgcagaagcctttccaaaagaagtgagttttgaactatattgaaacatgacaagaattcaccagtctaacaaaatgggaaacgtattcaaggcacaggaagcaacaagtgcaagacccaggaggaggcacccagacccttgggtacatattctcagctcctaaggacctccttcctaaagaagaaagagttgattgaagatttgataagcatgcatgtgcgtaggagtgggtctagtgtcattggaaaagtgaacctggaaataaagagaaaataaattgaactcggagct

SEQ ID NO: 348297 - DNA, 762 bp, Homo sapiens
cagatccgatacagtctatgatattgagcgttccccgatcctgtaatacaacacaaacaacaacttaagaacagacactgagctccttttgacctccttcctaaagaagaaagagttgattgaagatttgataagcatgcatgtgcgtaggagtgggtctagtgtcattggaaaagtgaacctggaaataaagagaaaataaattgaactcggagctaattcatgccttggaattaaatatacatatatataacatttttcttaactattgattatttatttattttaaatggtgggaatgcccagagataaatatgaacccaaattctctcagtatactaatttaaagctgccttctattatttatttatttattttaggctgctagcatgtttcttctaatggtgacattactgccagtctatcccacagtctaaaggagttaaataacttccagagatgacttgaggattctttgtattcatttaatagttcattttgggatgcttgacatgttaataaactagtgtgccatacatttaacttgaatacactgcatggcttccaagacttcaaccactggattgcttatgcacaggcacataagggactacattttggaattactagttactgacaatctatgatatctgaatcttgtttgacagcatatttttgaatactgaatgaagcaaaaagtaaaacaaaacaaaaaactggcaaataaagcattcttctaatgaaaacaaaattaataaaagc

SEQ ID NO: 348298 - DNA, 648 bp, Homo sapiens
  misc_feature (70)..(70): n is a, c, g, or t
tggccaccccccccctccccctcccccccccgcacatcctctactcgcttttgcgccccgccggttccanttcaatgataaccggccatggctgatcctgggaacagaggagggatccaccgccccttgagcttcacctgctccctgctcattgtgggaatgtgctgtgtatctcctttcttctgccatagccagacagacttgctggctcttagccaagctgatcctcagtgctgggaatcctcctcagtgcttctcctggaaatgtggaaacctcgcgtttccaacactgtttcaggcttctgggattttatgatctacctgaagtcatctgagaacttgaagcatggagcactgttttgggatctggcccaactcttctgggacatctatgtggactgtgtgctctctaggaaccatggcttaggaaggaggcaattggttggagaggaagagaaaatctcagcagcgcagccacagcacacaaggagtaaacaaggtacatattctcagctcctaaggacctccttcctaaagaagaaagagttgattgaagatttgataagcatgcatgtgcgtaggagtgggtctagtgtcattggaaaagtgaacctggaaataaagagaaaataaattgaactcggagct

SEQ ID NO: 348299 - DNA, 778 bp, Homo sapiens
tgccttttaaagataatttattgatatttaattaacctgaaactaatttggtgatcttatgaagttccgcttttctactttcaggtacatattctcagctcctaaggacctccttcctaaagaagaaagagttgattgaagatttgataagcatgcatgtgcgtaggagtgggtctagtgtcattggaaaagtgaacctggaaataaagagaaaataaattgaactcggagctaattcatgccttggaattaaatatacatatatataacatttttcttaactattgattatttatttattttaaatggtgggaatgcccagagataaatatgaacccaaattctctcagtatactaatttaaagctgccttctattatttatttatttattttaggctgctagcatgtttcttctaatggtgacattactgccagtctatcccacagtctaaaggagttaaataacttccagagatgacttgaggattctttgtattcatttaatagttcattttgggatgcttgacatgttaataaactagtgtgccatacatttaacttgaatacactgcatggcttccaagacttcaaccactggattgcttatgcacaggcacataagggactacattttggaattactagttactgacaatctatgatatctgaatcttgtttgacagcatatttttgaatactgaatgaagcaaaaagtaaaacaaaacaaaaaactggcaaataaagcattcttctaatgaaaacaaaattaataaaagc

SEQ ID NO: 348300 - DNA, 875 bp, Homo sapiens
  misc_feature (70)..(70): n is a, c, g, or t
tggccaccccccccctccccctcccccccccgcacatcctctactcgcttttgcgccccgccggttccanttcaatgataaccggccatggctgatcctgggaacagaggagggatccaccgccccttgagcttcacctgctccctgctcattgtgggaatgtgctgtgtatctcctttcttctgccatagccagacagacttgctggctcttagccaagctgatcctcagtgctgggaatcctcctcagtgcttctcctggaaatgtggaaacctcgcgtttccaacactgtttcaggcttctgggattttatgatctacctgaagtcatctgagaacttgaagcatggagcactgttttgggatctggcccaactcttctgggacatctatgtggactgtgtgctctctaggaaccatggcttaggaaggaggcaattggttggagaggaagagaaaatctcagcagcgcagccacagcacacaaggagtaaacaaggtggtcaaccccagctcccatgtcttttgaaagggtcaatcaagtatgaatgtgctgaattgtgaggaagagggaaatggcattaggggaatccagtgtcatatatattcctctcaagaggtgaaccccaagagcacataactgataggaagatagatagtacttctttttgcattgcatagtagctgtttatatcaacatattgtcctcatcctcatacttcctgtgaacagcagcaaggaagagtcagaaagaaaagacaaaaagcatgattcccaaaatacagcataaaagtataaacagatcccccaagatcaacattattttttactattagcctgaacactggcagtcataacctgatgtttacttgccg

SEQ ID NO: 348301 - DNA, 203 bp, Homo sapiens
acgaggctgaagaataataaatcaccaatgatttgttcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactca

SEQ ID NO: 348302 - DNA, 1058 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcacttttt

SEQ ID NO: 348303 - DNA, 307 bp, Homo sapiens
tgcgtcgcactagcaggtcccgccgctctctctgtgggggagcctagatagcttggtagcaggggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcacttttt

SEQ ID NO: 348304 - DNA, 3303 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348305 - DNA, 2002 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaaaaaaaaaaaaaaaaaaaaaaaaaaaaatttttggggggcttgggccttggaaaaagttttttaaaaccctttcgttgtgggggggggggcccc

SEQ ID NO: 348306 - DNA, 1418 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcataaaaaaaaaaaaaaaaaaaaaaaaaaaaaaaaaaaaaaaaaaaaaaaaaaaaaacaaaaaaaaaaaaaaaacacaaacaacacaacaaaagaaaaaaaaaaaaaaaa

SEQ ID NO: 348307 - DNA, 1626 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcataaaaaaaaaaaaaaaaaaactttgtgcggccgccctgggcacacaagaaaagcttttaaaaccatagtcggtggggagacggggccccaagaaagggtaagggcacaactgtggcacaagagggggctacccagaggagaaacccggcgacacagagaaactggggcagtggggatctccgacccataaataagaaaacgcccggggggggacaacccgacagcgttctcgaaaacaacccacaaagggggtacggaggaccacacagggagaacatcacaaaggggagccacaacgaggccgaatatataatca

SEQ ID NO: 348308 - DNA, 3142 bp, Homo sapiens
  misc_feature (24)..(24): n is a, c, g, or t
  misc_feature (32)..(33): n is a, c, g, or t
agattcggcactaggcggaccttnacccagcnncacccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348309 - DNA, 1560 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcaaaaaaaaaaaaaaaaaaaaaaaaaaaaaaaaaaaaaaaaaaaaaaaaaaaaaaaaaaaaaaaaaaaaaaaaaaaacaacaaaaaacaaaaaaagaagaaggagagacaagacagacagacgaaaaacgaacaaaggagaggccaagccagagcgaggcggaccgggagcgggagaggagcgaccgggacgcgggcacgggcgcgcaggcgggagggggaggagaacacagtggggaagagacaaaaagacagaaaaagaggaaagaagaaacaagaaagaaaaaaaggacaaaacagaaaaaaaggacgaaataaacaaaagaggaaagaacgaaagaagaaaaacaacaaacaccagagaagagaa

SEQ ID NO: 348310 - DNA, 3002 bp, Homo sapiens
tgatctagaggatcctatagagcataccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348311 - DNA, 2971 bp, Homo sapiens
gctcgctactagtccacggttggctactagtccacggttggctactaggccacggttggctactagtccacggttggctactagtccacggttggctactagtccacggttggctactagtccacggttggctactagtccaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348312 - DNA, 3227 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348313 - DNA, 3302 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348314 - DNA, 3151 bp, Homo sapiens
  misc_feature (25)..(25): n is a, c, g, or t
  misc_feature (28)..(28): n is a, c, g, or t
  misc_feature (30)..(30): n is a, c, g, or t
  misc_feature (32)..(32): n is a, c, g, or t
  misc_feature (35)..(35): n is a, c, g, or t
  misc_feature (39)..(39): n is a, c, g, or t
  misc_feature (45)..(45): n is a, c, g, or t
aaaaagcagctgtaccgtccgaatnccngnanggntttntcgacnccttgcccagcggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348315 - DNA, 3695 bp, Homo sapiens
tttctttcgacggggtgtcaccgtgtaagccaggatggtcttgatctcctgacctcatgatctgcccacctcggcctcccaaaatgctgggattacaggtgtaagccaccacgcccagccctgaattgtttctttagaactatttctcagctactcaatttatgcataaaagattaaagtattcattaatgaatgttatgacctcagatttgtacacaataagttatacatgtgagatagtggaatatatacagaattaagatggtgaaacttgaaaatttctttctaaagttttcggttagatttctgtattcttcagtaattgcaaattgcagcacaaacatctccacacgtttctgtcctatccatttgttacctctcccaccaccacccctgaatccttgaaatgatagtctcttgagtagtatttaatgtttgcagagggagacaatacaggcatttcccccagacacagagatttttgaaaagttcaacaaacaaggaaaacttgctttggcagagaatttgataaagctttatagctgtactgtgttgaatatgcaaaatcttgagttaatgtggtgatggttactgtggatgttctcttgtttgtgtacatataaatgtttgctccagtggttacctggaaattagtatgcatatattattgattaataatggaatgagagctgttaaaaacattaaagcaaaactaccaacacgacaaaatttaccaaatcatgccacatattgtccttgaaacttaccccatttttacctaaccatatctggtatttgggtttaacttctttttacatttaaaggatacaaagatgtagcttcagaagaaattctatccagtttacaaaaatttagaattaccaaaatatagcatgtaagcttacctgcaatttgaagcacatctttttaaaggtttagtatgatattttggattcagactgaggcttctatgggattagattttcttcagttacttcagtaatcaccataatttaaaaattctggtattataacatttctaattttcttctcttttttataaagttccatcattttgctacagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348316 - DNA, 2831 bp, Homo sapiens
gctcgctactagtccacggttggctactagtccacggttggctactaggccacggttggctactagtccacggttggctactagtccacggttggctcatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348317 - DNA, 2552 bp, Homo sapiens
tattaaaataaagagaaagcctagccgggcgcgggggctcatgcctgtaatcccagcactttgggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348318 - DNA, 2552 bp, Homo sapiens
tgcgtcgcactagcaggtcccgccgctctctctgtgggggagcctagatagcttggtagcaggggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348319 - DNA, 2650 bp, Homo sapiens
  misc_feature (1)..(1): n is a, c, g, or t
  misc_feature (13)..(13): n is a, c, g, or t
  misc_feature (47)..(47): n is a, c, g, or t
  misc_feature (53)..(53): n is a, c, g, or t
  misc_feature (188)..(188): n is a, c, g, or t
ngacaggtttccnagatagaagctagcttgtattgggaggcatatcntgacgncagcaagaatcatcattgctacgtcaagatgagacggccgcagtgatcgctatatgtatcagatacgactgtgatgctcactatactgctgtgaggatgacatactcgtagcaggagatgcacgtgcatgtgcanagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348320 - DNA, 1415 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcaggcagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcaaaaaaaaaaaaaaaaaaaaaaaaaaaaaaatttttggggggcttgggccttggaaaaagttttttaaaaccctttcgttgtgggggggggggcccc

SEQ ID NO: 348321 - DNA, 848 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcaggtgaaatggtaactgggatcctctagacgccacc

SEQ ID NO: 348322 - DNA, 1235 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcat

SEQ ID NO: 348323 - DNA, 1176 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactca

SEQ ID NO: 348324 - DNA, 1484 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcaaaaaaaaaaaaaaaaaaaaaaaaaaaaaaaaaaaaaaaaaaaaaaaaaaaaaaaaaaaaaaaaaaaaaaaaaaaacaacaaaaaacaaaaaaagaagaaggagagacaagacagacagacgaaaaacgaacaaaggagaggccaagccagagcgaggcggaccgggagcgggagaggagcgaccgggacgcgggcacgggcgcgcaggcgggagggggaggagaacacagtggggaagagacaaaaagacagaaaaagaggaaagaagaaacaagaaagaaaaaaaggacaaaacagaaaaaaaggacgaaataaacaaaagaggaaagaacgaaagaagaaaaacaacaaacaccagagaagagaa

SEQ ID NO: 348325 - DNA, 1196 bp, Homo sapiens
  misc_feature (674)..(674): n is a, c, g, or t
  misc_feature (677)..(677): n is a, c, g, or t
  misc_feature (680)..(681): n is a, c, g, or t
  misc_feature (690)..(690): n is a, c, g, or t
  misc_feature (697)..(697): n is a, c, g, or t
  misc_feature (699)..(699): n is a, c, g, or t
  misc_feature (716)..(716): n is a, c, g, or t
  misc_feature (735)..(735): n is a, c, g, or t
  misc_feature (747)..(748): n is a, c, g, or t
  misc_feature (754)..(754): n is a, c, g, or t
  misc_feature (756)..(756): n is a, c, g, or t
  misc_feature (759)..(759): n is a, c, g, or t
  misc_feature (775)..(775): n is a, c, g, or t
  misc_feature (780)..(780): n is a, c, g, or t
  misc_feature (791)..(791): n is a, c, g, or t
  misc_feature (808)..(808): n is a, c, g, or t
  misc_feature (812)..(812): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaagnggnagnnggggggganggggggngnggggggggagggggggnggggaatgtgagcgggggnggatggggaagnngagagngnganggggggaggggggganggggnggggggggggngggaatgagaaggactnggtnggcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactca

SEQ ID NO: 348326 - DNA, 825 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtccaaaagatgagggactgtgctctgccaatgtgactcgctattattttaatccaagatacagaacctgtgatgctttcacctatactggctgtggagggaatgacaataactttgttagcagcggagagcagcagaatcacgggctgac

SEQ ID NO: 348327 - DNA, 739 bp, Homo sapiens
  misc_feature (716)..(716): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtccaaaagatgagggactgtgctctgccaatgtgatcgatnacaccggtatcagctcggattcc

SEQ ID NO: 348328 - DNA, 598 bp, Homo sapiens
gaaaatgcgtattcatgtgaataagctttgattcactgcatatgtacaatcagagaacacccagagaaaacagagagtctttctactgaacttgaaagatacatcacagctgagtcagctctgaatacactgttagaaaaaaaaaaagtaaatatctggattcatgggagtattctgggtatttactatcccaacactaatacaacttctctccccccacaaaatgttgctgaaaatacagtgatggtttaataagaaggctacttttgactaacattgttctattaccctccttttcctagaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaagtaaatacgatttttatggtatttctatttcacttttttgaaaagacatttgggtggaaaaaactcaatttgatgcgaaattaacatgtgcattttc

SEQ ID NO: 348329 - DNA, 1311 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcat

SEQ ID NO: 348330 - DNA, 1193 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactca

SEQ ID NO: 348331 - DNA, 1909 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaa

SEQ ID NO: 348332 - DNA, 1775 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaatcacatagcatgatgtgattgttcaaggccaaggtcatggcttgcaatgccgataaacttctaaaagcctggacggggatttctgttaacgcattgtcatccagccacaggtgcctcagggattgaaggcttcgcaaattctgcagagcttctgtgggtacgtgtcttagctgattattctgcagcatactgtatgttaaaagaaataaagaaaaatgttaaaaaaaatgaacaataacaggcctaaacaaggccaggcactgttccaggtgtcagaaaaacaacagagcatcagacaaagtcttgtcttagggggagctgaaattcctgtgaagagtgcagatacttaaagatgtacacatgaatattttaacctgagacaagtgatctatgtgttcttctga

SEQ ID NO: 348333 - DNA, 1490 bp, Homo sapiens
  misc_feature (1366)..(1366): n is a, c, g, or t
  misc_feature (1371)..(1371): n is a, c, g, or t
  misc_feature (1376)..(1376): n is a, c, g, or t
  misc_feature (1454)..(1454): n is a, c, g, or t
  misc_feature (1467)..(1467): n is a, c, g, or t
  misc_feature (1486)..(1486): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcataaaaaaaaaaaaaaaaaaaaaaaaaaaaaaaaaaaaaaaaaaaaaaaaaaaattncctgnggccncaggctttttccctttggtgggggttatttttggcttggccctggccgtccgttttccaccgtcgtgcctgggggaanccccggggggttnccccacctttttccccttnacgg

SEQ ID NO: 348334 - DNA, 1298 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacattaactttcaggatcacgatgtcactcaaggaacagctatgccatagtacgtc

SEQ ID NO: 348335 - DNA, 1300 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcaaaaaaaaaaaaaaaaaaaaaaaaaaaaaaaaaaaaaaaaaaaaaaaaaaaaaaacaaaaaaaaaaaaaaaacacaaacaacacaacaaaagaaaaaaaaaaaaaaaa

SEQ ID NO: 348336 - DNA, 2854 bp, Homo sapiens
gaggatccccaattagcttggcacaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348337 - DNA, 3429 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactggctgtggagggaatgacaataactttgttagcaggcagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348338 - DNA, 3286 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348339 - DNA, 3028 bp, Homo sapiens
gttcagagcgtcccgtatgtgctgtctcagcgagcaaccacgatatagctgcgtagatcggtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348340 - DNA, 3019 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtccaaaagatgagggactgtgctctgccaatgtgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348341 - DNA, 2644 bp, Homo sapiens
agactcgctggggcacaggcctcctggtcctggacggttcctgagagaactccaccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtccaaaagatgagggactgtgctctgccaatgtgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcatttcttggggtcgtattcctgatttcagaagaggatcataactgaaacaacataagacaatataatcatgtgcttttaacatatttgagaataaaaaggactagcaaataaaactcattttgcatttaaaagttggattatattttagtcccaagaagacaaagtcgcagattaacaacactttaaaaatattactcccattttattgtgttagattgcagtacaatgaatgaataaggggatttatttaaaagatcttaactttcttgactgatttaaaaagctaatcaatttattaaagccagaaatgttctcctctgggaaagcaatttctatctatttatctaccaatccccactcacatgtatatgtttgtgtttacatagagatagatggttttaagggttttcctattgttaaattatttcctaagacattgtgggttggagaccactaaacttataaaaaaccaaggaaagtaaagtttttcaaatgtttatactgtttaaggtgtttatttatataaaccatgcatgagaaaccatgcataaatttaataatttaaatttcaccagtaaattatcattgattaaatatggtcataccaatgaaataggttttttctttctctgtaataaaacaatttttctaaattcttatgttttcatagcaagattaacatatttaattacaaattaaatatgcaaaatgacaaatgcgtttaccttttgcttgaacaatctttcatttaaaaatttatcccagttattttgacaaataggtatatgcctgagaactttgaatgatgctgaaagctagaagcaaaccaggtactcttcagtcagggactggttgaagattttatggatgaggagttagcaaaatatctatatatgcatatcttctgactcccaggatacataagaaacacagggcctagaacagtatgaataaacacacatatacacaaacatcacagaagatactaaagatattaaaaatgtttacctatagaggtttggagagaacagaggggtggacagttgtggagataatatttgtgtaaatataactgtgatatagtttttatcttggaccatgtaaatatttgacataattaataatcaaaattaaatacaaaagaaaaagcatttctttaagcattcaaacccaactgaataccaaatagtggcaaaactacacaaaagatatatacttattttcaatgacttcacaaattaatatgagaatgtctttgggggaatataaaggtgaaaaaattctgaagaaatctcaaaatgcatttttaaatttgttattactttttatttgaatagttttgggagttacaagtggttttttattacatggatgaattatattgccagtgaattctgagattttagtgcactgtgaaaatgcatttagtagtctcattgttaatggtaatactggtgttattttgaacctattgtatctagaatactatgttgtaagaaaacaagtagttacatttctttagaagtcaggattttcagtgttaagagaaaatgagatacaagtatacaatgaaagaaattaagtaaaaatctttgacttaaattggaattagaaatattcatataaattaataactgattttctctatcaaaaaatctgtatttcccacttttccattgaaaagtccttgaagtaatgacaactcagtagcagtagttacaatgaacatcaagactgtggtctctccatactattactcactggttcctaagaaccagtgctcttaggagaatagctgaatccaggtctggggcaggaaatatgtaaaataaacttgggccatcttactccagaaatcaaggaagctatcaaagactaatgaatcatgtcacaaaaacgggagcaatattaaggagctcccactaacctaaaatgagacaatatggccatcaaaacaaataatgaccacaatgtatataaatatatagaaatctgagtttatgattatatacacacactcacctccttggtaccttttggaggtttctagggcattatctcattcatttgaaaacgatgaattaacagaaagaataaagcatttatcctt

SEQ ID NO: 348342 - DNA, 859 bp, Homo sapiens
  misc_feature (803)..(803): n is a, c, g, or t
  misc_feature (844)..(844): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaattccatcattttgctacagtccaaaagatgagggactgtgctctgccaatgtgactcgctattattttaatccaagatacagaacctgtgatgctttcacctatactgggctggtgggaaggggaaatgancaaattaaactttggttaagccaagggggagggaattggcnaaaaccgttgccatg

SEQ ID NO: 348343 - DNA, 1117 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaaatacagaacctgtgatgctttcacctatactggctgtggagggaatgacaataactttgttagcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactca

SEQ ID NO: 348344 - DNA, 1303 bp, Homo sapiens
  misc_feature (674)..(674): n is a, c, g, or t
  misc_feature (677)..(677): n is a, c, g, or t
  misc_feature (680)..(681): n is a, c, g, or t
  misc_feature (690)..(690): n is a, c, g, or t
  misc_feature (697)..(697): n is a, c, g, or t
  misc_feature (699)..(699): n is a, c, g, or t
  misc_feature (716)..(716): n is a, c, g, or t
  misc_feature (735)..(735): n is a, c, g, or t
  misc_feature (747)..(748): n is a, c, g, or t
  misc_feature (754)..(754): n is a, c, g, or t
  misc_feature (756)..(756): n is a, c, g, or t
  misc_feature (759)..(759): n is a, c, g, or t
  misc_feature (775)..(775): n is a, c, g, or t
  misc_feature (780)..(780): n is a, c, g, or t
  misc_feature (791)..(791): n is a, c, g, or t
  misc_feature (808)..(808): n is a, c, g, or t
  misc_feature (812)..(812): n is a, c, g, or t
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaagnggnagnnggggggganggggggngnggggggggagggggggnggggaatgtgagcgggggnggatggggaagnngagagngnganggggggaggggggganggggnggggggggggngggaatgagaaggactnggtnggcagggaggattgcaaacgtgcatgtgcaaaagctttgaaaaagaaaaagaagatgccaaagcttcgctttgccagtagaatccggaaaattcggaagaagcaattttaaacattcttaatatgtcatcttgtttgtctttatggcttatttgcctttatggttgtatctgaagaataatatgacagcatgaggaaacaaatcattggtgatttattcaccagtttttattaatacaagtcactttttcaaaaatttggatttttttatatataactagctgctattcaaatgtgagtctaccatttttaatttatggttcaactgtttgtgagactgaattcttgcaatgcataagatataaaagcaaatatgactcactcaaaaaaaaaaaaaaaaaaaaaaaaaaaaaaaaaaaaaaaaaaaaaaaaaaaaaaacaaaaaaaaaaaaaaaacacaaacaacacaacaaaagaaaaaaaaaaaaaaaa

SEQ ID NO: 348345 - DNA, 1119 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtccaaaagatgagggactgtgctctgccaatgtgactcgctattattttaatccaagatacagaacctgtgatgctttcacctatactggctgtggagggaatgacaataactttgttagcaggaggattgcaaacgtgcatgtgcaaaaaaagaaaaacaaaaaaaaaaacaaaaatttttggccggacatcaggcccacagcagaaaaggtttgtaagaaacccattcgtgcgttgggaggccggcagcaccccgagtggtgtaagggggaaagagcgacacacagcgcgggtcaccatagagaaaaaaccccgggacaagagaccaaagggcggagacatatcgcaccacaaacaagaaaatcgcgccgcggtgatcacaccgcaggtctgtggaaaccagcacccagagggggatcgcggggaaccaaagggagaagtac

SEQ ID NO: 348346 - DNA, 762 bp, Homo sapiens
cctcttacacagtttgcagcgcgggggcggcggggtgacagtccccgtgcatgaatcagccacccctcaggctccgccccggcgggggtcggccggacgctcgccccgcataaagcgggcacccgggccgcctggagagaaagccgcgcacctcctcccgccaggcgctttctcggacgccttgcccagcgggccgcccgaccccctgcaccatggaccccgctcgccccctggggctgtcgattctgctgcttttcctgacggaggctgcactgggcgatgctgctcaggagccaacaggaaataacgcggagatctgtctcctgcccctagactacggaccctgccgggccctacttctccgttactactacgacaggtacacgcagagctgccgccagttcctgtacgggggctgcgagggcaacgccaacaatttctacacctgggaggcttgcgacgatgcttgctggaggatagaaaaagttcccaaagtttgccggctgcaagtgagtgtggacgaccagtgtgaggggtccacagaaaagtatttctttaatctaagttccatgacatgtgaaaaattcttttccggtgggtgtcaccggaaccggattgagaacaggtttccagatgaagctacttgtatgggcttctgcgcaccaaagaaaacagtcccaaagatgagggactgtgctctgcccatgtgactcgctattattttaatccagacgactgacacggccatagagcgactgacag

SEQ ID NO: 348347 - DNA, 6333 bp, Homo sapiens
  misc_feature (113)..(115): n is a, c, g, or t
  misc_feature (119)..(120): n is a, c, g, or t
agtccagttgcttggagaggccttccaatcaactggactgggatgttcgaagcattcagcgctggtttcgacaaagacgcaatcaggagaagccaagcacgctgacgaggttnnntggnncatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtat

SEQ ID NO: 348348 - DNA, 6279 bp, Homo sapiens
  misc_feature (113)..(115): n is a, c, g, or t
  misc_feature (119)..(120): n is a, c, g, or t
agtccagttgcttggagaggccttccaatcaactggactgggatgttcgaagcattcagcgctggtttcgacaaagacgcaatcaggagaagccaagcacgctgacgaggttnnntggnncatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcatgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtat

SEQ ID NO: 348349 - DNA, 6279 bp, Homo sapiens
  misc_feature (113)..(115): n is a, c, g, or t
  misc_feature (119)..(120): n is a, c, g, or t
agtccagttgcttggagaggccttccaatcaactggactgggatgttcgaagcattcagcgctggtttcgacaaagacgcaatcaggagaagccaagcacgctgacgaggttnnntggnncatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggactgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtat

SEQ ID NO: 348350 - DNA, 6357 bp, Homo sapiens
  misc_feature (113)..(115): n is a, c, g, or t
  misc_feature (119)..(120): n is a, c, g, or t
agtccagttgcttggagaggccttccaatcaactggactgggatgttcgaagcattcagcgctggtttcgacaaagacgcaatcaggagaagccaagcacgctgacgaggttnnntggnncatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggctgggaagtggaaccctttacatgtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtat

SEQ ID NO: 348351 - DNA, 6560 bp, Homo sapiens
  misc_feature (113)..(115): n is a, c, g, or t
  misc_feature (119)..(120): n is a, c, g, or t
agtccagttgcttggagaggccttccaatcaactggactgggatgttcgaagcattcagcgctggtttcgacaaagacgcaatcaggagaagccaagcacgctgacgaggttnnntggnncatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagagtgcagtgtaagtgccctttactgtaaatgctaaccagctcgtgtgggtaaaacatcacatctcacctgatgaggttaataaaggctcacatcatcccagtagattgttacaagcctcgtcaactcccagtatcattgtgatcattgagaaagtaatgttacgttaacttggatagactgtagtatctctttgaaaattaagattaaaacctcaatgctaaa

SEQ ID NO: 348352 - DNA, 1437 bp, Homo sapiens
tgtgaatggtcggaccaagtatcagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtat

SEQ ID NO: 348353 - DNA, 4578 bp, Homo sapiens
  misc_feature (113)..(115): n is a, c, g, or t
  misc_feature (119)..(120): n is a, c, g, or t
  misc_feature (4474)..(4474): n is a, c, g, or t
  misc_feature (4478)..(4478): n is a, c, g, or t
  misc_feature (4488)..(4488): n is a, c, g, or t
  misc_feature (4494)..(4494): n is a, c, g, or t
  misc_feature (4512)..(4512): n is a, c, g, or t
  misc_feature (4531)..(4531): n is a, c, g, or t
  misc_feature (4558)..(4558): n is a, c, g, or t
agtccagttgcttggagaggccttccaatcaactggactgggatgttcgaagcattcagcgctggtttcgacaaagacgcaatcaggagaagccaagcacgctgacgaggttnnntggnncatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattttntaangggggaattnccaaangggtatttaaaagggttngttttaaccaggtattgtngtggggggatggtccaataatcctccngggggagggctttcaaggga

SEQ ID NO: 348354 - DNA, 296 bp, Homo sapiens
ctaaaatactaccagttgagtttaacttaccaagagagaatatattgtatgatactagttgctttaatatcctatgcctagctgttttaaagtttgtcagttctcacacaggtaaattattgaaatccaaaaatattagggcaagagcctattgtaaaccttttttatcctcttatccatgttctaaaatatgtaaaatattttttgtcatttttttcagaccccctggttgtggaatacgaggcattgctggtacaactacccctatcaggtaaggaggcattattgtctgggtt

SEQ ID NO: 348355 - DNA, 563 bp, Homo sapiens
caaccttggacctcctctgattatatttatactgaacagaaatttaatcacttctttccttttatgagaagggtcgcttggtgctgtatgccggtttaaacaaacctttctttcaaactgaaaaacaaatctgttcatgacttccaacaagatttagttaaatctttttggttaaaagtggacttgaggttgattcgaataaagcttcctaagcctcagccccaaccctgtgtgtagagcagagacttttccagatcattctctgtgacattttcttacttgtttgttctcttccttctgctaccctggaaggctgggaagtggaaccctttacatgtaagtttctcctcctctctctctatccctgtcctgagtgcctcttgcctgttggaggggcactcagatgcttttgtttccacgcatattgttctgtctaacctattggcactgtctagaggcttcatgtgagctgtagctctgtgaactgcaagagacactagagacagctctgttagggccctttggtgtgagcttgtattctgctaaatgttgcatgatccaac

SEQ ID NO: 348356 - DNA, 5632 bp, Homo sapiens
  misc_feature (113)..(115): n is a, c, g, or t
  misc_feature (119)..(120): n is a, c, g, or t
agtccagttgcttggagaggccttccaatcaactggactgggatgttcgaagcattcagcgctggtttcgacaaagacgcaatcaggagaagccaagcacgctgacgaggttnnntggnncatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgaattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagagtgcagtgtaagtgccctttactgtaaatgctaaccagctcgtgtgggtaaaacatcacatctcacctgatgaggttaataaaggctcacatcatcccagtagattgttacaagcctcgtcaactcccagtatcattgtgatcattgagaaagtaatgttacgttaacttggatagactgtagtatctctttgaaaattaagattaaaacctcaatgctaaa

SEQ ID NO: 348357 - DNA, 557 bp, Homo sapiens
ctagaggatccccgaaatggaacgaacaaaagaaaagaaaagaaatttacctagtctgaaaagagtcttctccctcatttttaaaaataacagctttatttatgtgatgttgaatcttctgagccagagttcagaaccaatacctagacctacaataattccttcatttttatataaacaaaaccattcctcttgtcctgacttattaatttcacttctttgccactcttgctctcacttttggaattacagcttttccttaggcacggaccagattagaaagattaagtagcttttgagctgtttgcatttcctccagatgaacaatctatataaaccattatctaattttgttcaggatgatcttctccatcctcattttacctactctgttttgcatgttcttcccactcacaaccccaattttgttcacatattatgtatcacagaacgtttagaaatggaagtcagaaaacaagtgataaagggaacattgtataaaagtaactcttctcattcattcaacaaatgtttctttaacaatctctatatttcag

SEQ ID NO: 348358 - DNA, 826 bp, Homo sapiens
ggcaaatggcaaagctggcattcaaacgcaatctgacagcgctctttacagctgcttcccaggagtaggacccagatattctagcaaccagttctccttttacttcatcatgcctgttttttaaaacataccctccgtgggatatgtactgtctaaatcatgagtgccagcagatttcacttttagggtgggcatcctttaatttgttatcagaatagggttgccatatttagcaaatacagaacctacttaacactacaaaaaaaatccttgtttatctgaaattcagaattaactgtgtgttccatgaacagatttgataacataagattataatttgatccaataagttgaataaactgaatgaataaactgttcaagaaacagttgatttgtgctcaactaaggatcaatgtactcatctttagtcaaactttgttgttgttttagtgagattttaattatatgtttcgtttttagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagaga

SEQ ID NO: 348359 - DNA, 2229 bp, Homo sapiens
  misc_feature (1)..(2): n is a, c, g, or t
nncacagaagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcagcagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgcggcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttctcatatttaatttgctgtttttaagatattccaacctagagtttttgatggaactgatatattgacagttctcaccgaagtccttttataaagaattgctactccaatatatggtcagattagatgcaagaataaagcagttgtccgagtctaagtttctattttattaataaaaactaaaatggtacgtactatcggtcatttcattttcattcttttaatcatgtattcaagcacaaacttgaaatttcatagccataaggtcaagatttagacctaccaaataaaaccttgggccagctgtgttaaggatttgctcaccttttcccaaactataccttgataattatttccttgataccctacttacaaaatgaagtagatgacattaaggcaaacagagactggccacgctggcttactcctgtaatcccagcaccttgtgaggccgaggcgggtggatcacctaaggtcaggagttcgagaccagcctcaccaatatgatgaaaccctgtctctactaaaaatacaaaaattagccgggcgtggtgacatgcgcctgtaatatcagctactcaggaggctgagacag

SEQ ID NO: 348360 - DNA, 2060 bp, Homo sapiens
  misc_feature (1)..(2): n is a, c, g, or t
  misc_feature (1629)..(1629): n is a, c, g, or t
  misc_feature (1953)..(1953): n is a, c, g, or t
nncacagaagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcagcagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgcggcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagaaaaanaacacaaaaaaaaacaaaaaatttttaaaaaaaaaaaaaaaaaaaaaaaaaaaaattttggggggggggggggaaaagaagattattcaaacacacatcgtgcggcgggccgggggacgccgaaattgtataagtggcaacatggccacacgctgtcgcccagaagaaaacctgggcccgacagaggggctcgggttgcccccccaaaaaaaaagcgcggggggaccaggccgtctgcgaaaacacacaaggggctccgggcgaccaggcgctttcaaaccgagggcccaggagtcgttaaccgcgcccgccgcagctagaggncagagcaggcacaacaacagcgccgcagcgaccagccaacaacgaacacaacacgacagccacgcgacgaaagctaagtacgatacacgcagccagagatagagaca

SEQ ID NO: 348361 - DNA, 1431 bp, Homo sapiens
ggcaaatggcaaagctggcattcaaacgcaatctgacagcgctctttacagctgcttcccaggagtaggacccagatattctagcaaccagttctccttttacttcatcatgcctgttttttaaaacataccctccgtgggatatgtactgtctaaatcatgagtgccagcagatttcacttttagggtgggcatcctttaatttgttatcagaatagggttgccatatttagcaaatacagaacctacttaacactacaaaaaaaatccttgtttatctgaaattcagaattaactgtgtgttccatgaacagatttgataacataagattataatttgatccaataagttgaataaactgaatgaataaactgttcaagaaacagttgatttgtgctcaactaaggatcaatgtactcatctttagtcaaactttgttgttgttttagtgagattttaattatatgtttcgtttttagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttctcatatttaatttgctgtttttaagatattccaacctagagtttttgatggaactgatatattgacagttctcaccgaagtccttttataaagaattgctactccaatatatggtcagattagatgcaagaataaagcagttgtccgagtctaagtttctattttattaataaaaactaaaatggtacgtactatcggtcatttcattttcattcttttaatcatgtattcaagcacaaacttgaaatttcatagccataaggtcaagatttagacctaccaaataaaaccttgggccagctgtgttaaggatttgctcaccttttcccaaactataccttgataattatttccttgataccctacttacaaaatgaagtagatgacattaaggcaaacagagactggccacgctggcttactcctgtaatcccagcaccttgtgaggccgaggcgggtggatcacctaaggtcaggagttcgagaccagcctcaccaatatgatgaaaccctgtctctactaaaaatacaaaaattagccgggcgtggtgacatgcgcctgtaatatcagctactcaggaggctgagacag

SEQ ID NO: 348362 - DNA, 3303 bp, Homo sapiens
  misc_feature (1)..(2): n is a, c, g, or t
nncacagaagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcagcagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgcggcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaacccgtatgtttaagtgttaataagtctcttatatattatagttaattcttcatcttgatttggtttgttgccgatgtttctaatttttgcaatggatttaaaaaggatgagctggtaaaacgtccctggctgtaaaatttaattcttgtactattctctcattatatttccttttacatttttaaccaatgattttttgggcgtcatgatttttgaacatatcccataaatgttggataacaattctcattccttatgaaagaccataaaatcacataagaaaaatttacgttgcttttttcttcctcaagaggtttttgtttcgtttttgttttttcgttttgagacagggtctcactctgttaccccgggtggaatgcagtggcaccatcatggcgcactgcagccttagcctcccaagatcaagttgctcccatgtcagcctccccagtagctgggactacaggcatgcttaaccatgcctggctaattttgttgttgtagtcgtttgtaaagatggcatctccctatgttcctcaggctggtcttgaactctcggtctcaagcaatcctcctgcctcgaccagcccctcaagagttttcgattttattttattttctatttttgttcatatatttccagtttttacttatttatgtttgcattttatgtttaacatacttaaaactttttttggtattttgtgaagacaaatccatatgctgtttggttaatgtatacagaacacattgtgaaatacagattatagaagattcctctcataggatattactgcttatagaaatgctggacgttttcaatagtgattttgtctttaacttgaattgtagctttggacttgaagctactgctaaaggtagcaggaattttaacatgctgacagttaagtactcaaacatttgttaacaagttacattttaacttttacactggtaattcttaaaattactttgttacttgaagtgatagattagtaacctgtataacagttttccaaaataattgtcaactgaaaatgtgatatcaccaaatcgatgtcttgttctgtgtcttagcttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttctcatatttaatttgctgtttttaagatattccaacctagagtttttgatggaactgatatattgacagttctcaccgaagtccttttataaagaattgctactccaatatatggtcagattagatgcaagaataaagcagttgtccgagtctaagtttctattttattaataaaaactaaaatggtacgtactatcggtcatttcattttcattcttttaatcatgtattcaagcacaaacttgaaatttcatagccataaggtcaagatttagacctaccaaataaaaccttgggccagctgtgttaaggatttgctcaccttttcccaaactataccttgataattatttccttgataccctacttacaaaatgaagtagatgacattaaggcaaacagagactggccacgctggcttactcctgtaatcccagcaccttgtgaggccgaggcgggtggatcacctaaggtcaggagttcgagaccagcctcaccaatatgatgaaaccctgtctctactaaaaatacaaaaattagccgggcgtggtgacatgcgcctgtaatatcagctactcaggaggctgagacag

SEQ ID NO: 348363 - DNA, 2900 bp, Homo sapiens
  misc_feature (1)..(2): n is a, c, g, or t
nncacagaagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcagcagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgcggcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaagattcatcccaccggaaaaatgtttattctttcagatggagaaggaaaaaatggaaccatcgagttgatggaacccgtatgtttaagtgttaataagtctcttatatattatagttaattcttcatcttgatttggtttgttgccgatgtttctaatttttgcaatggatttaaaaaggatgagctggtaaaacgtccctggctgtaaaatttaattcttgtactattctctcattatatttccttttacatttttaaccaatgattttttgggcgtcatgatttttgaacatatcccataaatgttggataacaattctcattccttatgaaagaccataaaatcacataagaaaaatttacgttgcttttttcttcctcaagaggtttttgtttcgtttttgttttttcgttttgagacagggtctcactctgttaccccgggtggaatgcagtggcaccatcatggcgcactgcagccttagcctcccaagatcaagttgctcccatgtcagcctccccagtagctgggactacaggcatgcttaaccatgcctggctaattttgttgttgtagtcgtttgtaaagatggcatctccctatgttcctcaggctggtcttgaactctcggtctcaagcaatcctcctgcctcgaccagcccctcaagagttttcgattttattttattttctatttttgttcatatatttccagtttttacttatttatgtttgcattttatgtttaacatacttaaaactttttttggtattttgtgaagacaaatccatatgctgtttggttaatgtatacagaacacattgtgaaatacagattatagaagattcctctcataggatattactgcttatagaaatgctggacgttttcaatagtgattttgtctttaacttgaattgtagctttggacttgaagctactgctaaaggtagcaggaattttaacatgctgacagttaagtactcaaacatttgttaacaagttacattttaacttttacactggtaattcttaaaattactttgttacttgaagtgatagattagtaacctgtataacagttttccaaaataattgtcaactgaaaatgtgatatcaccaaatcgatgtcttgttctgtgtcttagcttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttctcatatttaatttgctgtttttaagatattccaacctagagtttttgatggaactgatatattgacagttctcaccgaagtccttttataaagaattgctactccaatatatggtcagattagatgcaagaataaagcagttgtccgagtctaagtttctattttattaataaaaactaaaatggtacgtactatcggtcatttcattttcattcttttaatcatgtattcaagcacaaacttgaaatttcatagccataaggtcaagatttagacctaccaaataaaaccttgggccagctgtgttaaggatttgctcaccttttcccaaactataccttgataattatttccttgataccctacttacaaaatgaagtagatgacattaaggcaaacagagactggccacgctggcttactcctgtaatcccagcaccttgtgaggccgaggcgggtggatcacctaaggtcaggagttcgagaccagcctcaccaatatgatgaaaccctgtctctactaaaaatacaaaaattagccgggcgtggtgacatgcgcctgtaatatcagctactcaggaggctgagacag

SEQ ID NO: 348364 - DNA, 1221 bp, Homo sapiens
  misc_feature (1)..(2): n is a, c, g, or t
nncacagaagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcagcagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgcggcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagaga

SEQ ID NO: 348365 - DNA, 1551 bp, Homo sapiens
  misc_feature (1)..(2): n is a, c, g, or t
nncacagaagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcagcagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgcggcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagaga

SEQ ID NO: 348366 - DNA, 1590 bp, Homo sapiens
  misc_feature (1)..(2): n is a, c, g, or t
nncacagaagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcagcagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgcggcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagaga

SEQ ID NO: 348367 - DNA, 466 bp, Homo sapiens
aaaggaaaatgaggctgaaatggtaagtagcctgctcaaaatcacacagcaagtaaatgacagaacttaaatagaatccaaatactattatttccagttcagtacctgtattacttagggcttggttcatccgcaaatcacataataaaatagttgctcaaacagaacagaactttgtgtctcacataaaggaagttcaaaggaaagttcaaaggactggtatggcaacttcacaactctttgacttcactcttcagctatccttacaacgtaccctagttctcatggtcttagatgctggctagaattctacataatcatcatatccacattccaggataagggaagtgggggcaggggagaggagtaaggaaggtacacagcagtgtgtttttaaaagatttcctagaatctgcaacacaacatttcttcttatatcccattggccagaaacttcatcataatc

SEQ ID NO: 348368 - DNA, 1624 bp, Homo sapiens
  misc_feature (1)..(2): n is a, c, g, or t
nncacagaagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcagcagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgcggcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagaga

SEQ ID NO: 348369 - DNA, 1827 bp, Homo sapiens
  misc_feature (1)..(2): n is a, c, g, or t
nncacagaagctactcagataagaggctccaagaggacatttttggatgtgaaaaacaatgagaaggaggacaacacacatttacaatcgtcttaattttgtactcagaaaaaggatgtgaagacaatgcacagggaatacaatagtttcagatctgtgtacagtttccttttgcttcatctcctgcaacaatgtaatgaagacaccatgatatcattaacatttcacacaaaaggaaaatgaggctgaaatggtgtgggcaaggcccaggaatctggagcatccctaaccaagcagcagagcacctgggatagagaaagtgctcaagaatgttcacttactgattactacaatcaaaaaaagatacgacactaatttaccacattcttcttacttattttatgagatactattcttccaaggtggagaaagtggagaaagtagagtgacgcagctaagggagtaaatcgaccctcagccaacaagtggcaaaagcctgaagaaagtgatcaagatcactgatgaccccgcggcccatctccaagggggcgggtatcacaaccccgacgccacaccacgtatcattccgcaaaactcccgcgcctcccacgcagaactggcaagagggaaggcgagacagcagtgaacagctggtacgcagcacccacagcaccgcggcagcagctagtgccgactcccgcctagctcttttgactctgttcgcgggaagaatggggaaacagtaaggttgcggcgcctcccgcgagacgaggtacctgaggctggccccgcagtcccccgccgcaccagcaccggagcttcacaccccacttccggggtcaagtcaccgccgggaatcctgtgatcgcagaaaggtagtctcaggttccgcccctatccaagtcccgcctccactgcctctcgccctgtatctgtcaacttccgggacgccgcgcgtcactaagcagccaatctccacttccggactcatccagccccttctccacccctttcagagacagcgcgattgcgatttaggtttccgcgcatttaattggcgaagctggagcgctagtcttcgctgattggtgccgagaaatctgccccatagacacccgcggggcgcacagtttcagtcgtccgtgggtttcccgccagccgcagtcttggaccataatcatggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgagggagagatttctgtgctttctcatatttaatttgctgtttttaagatattccaacctagagtttttgatggaactgatatattgacagttctcaccgaagtccttttataaagaattgctactccaatatatggtcagattagatgcaagaataaagcagttgtccgagtctaagtttctattttattaataaaaactaaaatggtacgt

SEQ ID NO: 348370 - DNA, 1197 bp, Homo sapiens
tgcattcggctgacagagcatgagggggaggaatcactgatgacaggcactggcctgcccagctgggggcctttgtttattcatttggtgggcacttcctgggtgcctgctctgggtcaggcctgtgggggggaccactgagggcaggaaacctggcctgtccctccaggaagcgaagtcaacactggcacctgcagatgaagtggcagagcagcccccagctttgatggcatggggtggttggggggcacattctgcatgctcagaagagagagcaactcgccctgtggaaggagcatacagtgggagatggggacaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 348371 - DNA, 1759 bp, Homo sapiens
aagaactttaaaaatcacctaggtgtgggccgggcacggtggctaacgcctgtaatcccagcactttgagatgctgaggcaggtggatcacgaggtcaggagatcgagaccatcctggataacacggagaaaccccggcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 348372 - DNA, 224 bp, Homo sapiens
tagaatcgagctcggcccacttttatttctctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 348373 - DNA, 2115 bp, Homo sapiens
aagaactttaaaaatcacctaggtgtgggccgggcacggtggctaacgcctgtaatcccagcactttgagatgctgaggcaggtggatcacgaggtcaggagatcgagaccatcctggataacacggagaaaccccggcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagcaaaaacacacacaacacaacaaacaaaaacacacagtggacacctatgactataaagagatcttatcaagacaagggcgccaacactattaaagacgtaccccatgcataactataccaacacaaggagcgccccaatataatggacgaggatggccgctacaatcacagctgaccggcgcactcggagcgcaccattcctagacaaacagcgtcatcgaaccagtcgcgcacaccagccgatgtccaatacgtcgtgactttcaatcaacgcaaacaacgaaccaactaaacgaatcatccgagacgcgctaccacaagaagtgatcgaccacctgccccccacgtacgccacacc

SEQ ID NO: 348374 - DNA, 1667 bp, Homo sapiens
aagaactttaaaaatcacctaggtgtgggccgggcacggtggctaacgcctgtaatcccagcactttgagatgctgaggcaggtggatcacgaggtcaggagatcgagaccatcctggataacacggagaaaccccggcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 348375 - DNA, 1086 bp, Homo sapiens
gtgagaacccagggctcgctgggatgctgtcctccctccctccctccctctgccaagctggtgggaaggcccttgccaaagcgcacaagaccccttcacacagcaggggcacaagctcttcgaggcagagtcgcctgcaggtggggtggaaggggtgcgccccagacccaagaatcgcccgcctctccaagaccatccctggctgctggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 348376 - DNA, 1098 bp, Homo sapiens
tgcattcggctgacagagcatgagggggaggaatcactgatgacaggcactggcctgcccagctgggggcctttgtttattcatttggtgggcacttcctgggtgcctgctctgggtcaggcctgtgggggggaccactgagggcaggaaacctggcctgtccctccaggaagcgaagtcaacactggcacctgcagatgaagtggcagagcagcccccagctttgatggcatggggtggttggggggcacattctgcatgctcagaagagagagcaactcgccctgtggaaggagcatacagtgggagatggggacaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 348377 - DNA, 1473 bp, Homo sapiens
aagaactttaaaaatcacctaggtgtgggccgggcacggtggctaacgcctgtaatcccagcactttgagatgctgaggcaggtggatcacgaggtcaggagatcgagaccatcctggataacacggagaaaccccggcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcaggcccagtgacgagcaccatccggaagtgaaggctgatgggcacttcctggccctgcggggtgccctgtctctggctggagctgatgagccgtggtgtgatgcttgcctgggggtcggtgttgcctagaagtgaggaatgacctccttcacccctggctccttccggcagcctggccacttccagcatgtggagggggcccgggccctggcagagacggtgtggaaccgccggccgcatgcggggctggagttcggggctgccaatgggctaaggccctgtgttcaacacatgtcgcggaactgtcgtgaaaaaaagactcaggaccacaggtccggggtgctcccaggggtctttcccaccgaggctgggagtgagcagcagcctaggcccagccacacctcccaggctcgggagctgccaggccaggcaaccgtgaagggtagcagggtggggggtggaggggaggacagggagagcaggcctctcgggcctcacccacccttgcaccttccagctctagggcccacacagtaccaagccctgggctcaatgtaccacttatgaaaactcaattcaaattggcttagtgca

SEQ ID NO: 348378 - DNA, 952 bp, Homo sapiens
aagaactttaaaaatcacctaggtgtgggccgggcacggtggctaacgcctgtaatcccagcactttgagatgctgaggcaggtggatcacgaggtcaggagatcgagaccatcctggataacacggagaaaccccggcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcagagccgctcaacacgtgttgcaaggcacgtgctctggacctggtgctcacacgtgctcttctcccaagacactccctgaagcgcgttcccca

SEQ ID NO: 348379 - DNA, 400 bp, Homo sapiens
cccccagaatcccagccagagggcagtttatccaggagcccggtgcctcctctgttgggtgggcgtggcctcagagggcaccaaccagaagacacatgctgtcactgacatgcgggcccccagcgttagggcaggcaggagctccgagtctctaccccagctgtccccacagtgcacatggactaggctcctcccacggggcactaggccaggccaggggtgtggggtgagcccctggggagcccagagcagggtacactcatgtccccaccatccaaggtgagatgtctgtgctggaggcccagagggagctgggccggctgtcactccaccacaaggctgagcaggctccccagtgggagacaggtttggggaggtgtccaggttgagggcacagtca

SEQ ID NO: 348380 - DNA, 800 bp, Homo sapiens
gtgagaacccagggctcgctgggatgctgtcctccctccctccctccctctgccaagctggtgggaaggcccttgccaaagcgcacaagaccccttcacacagcaggggcacaagctcttcgaggcagagtcgcctgcaggtggggtggaaggggtgcgccccagacccaagaatcgcccgcctctccaagaccatccctggctgctggcccagtgacgagcaccatccggaagtgaaggctgatgggcacttcctggccctgcggggtgccctgtctctggctggagctgatgagccgtggtgtgatgcttgcctgggggtcggtgttgcctagaagtgaggaatgacctccttcacccctggctccttccggcagcctggccacttccagcatgtggagggggcccgggccctggcagagacggtgtggaaccgccggccgcatgcggggctggagttcggggctgccaatgggctaaggccctgtgttcaacacatgtcgcggaactgtcgtgaaaaaaagactcaggaccacaggtccggggtgctcccaggggtctttcccaccgaggctgggagtgagcagcagcctaggcccagccacacctcccaggctcgggagctgccaggccaggcaaccgtgaagggtagcagggtggggggtggaggggaggacagggagagcaggcctctcgggcctcacccacccttgcaccttccagctctagggcccacacagtaccaagccctgggctcaatgtaccacttatgaaaactcaattcaaattggcttagtgca

SEQ ID NO: 348381 - DNA, 1660 bp, Homo sapiens
aagaactttaaaaatcacctaggtgtgggccgggcacggtggctaacgcctgtaatcccagcactttgagatgctgaggcaggtggatcacgaggtcaggagatcgagaccatcctggataacacggagaaaccccggcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 348382 - DNA, 1048 bp, Homo sapiens
aactcaggggagagctgcaactaactcaggggcgagctgccaagtctgccctgcaagcgataggagtggaagcccaccgccgtcatgattggggacgatatcgtgggcgacgtcggcggtgcccagcggtgtggaatgagagcgctgcaggtgcgcaccgggaagttcaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctctcctccacccctgcctcccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 348383 - DNA, 998 bp, Homo sapiens
ctccgagtctctaccccagctgtccccacagtgcacatggactaggctcctcccacggggcactaggccaggccaggggtgtggggtgagcccctggggagcccagagcagggtacactcatgtccccaccatccaaggcccagtgacgagcaccatccggaagtgaaggctgatgggtacgtggacaacctcgcagaggcagtggacctgctgctgcagcacgccgacaagtgatggcctcctgggagagccccgcctcctccacccctgcctccctccacccctgcctctcctccacccgcccaggagagccccacctcctccacccctgcctctcctccacccctgcctcccctccacctgccccagtgcccagaccaaccaaggccctgacagccctgccttctgccctctgccctgcatgggcaggcatttgttccctacctgggtggcctgctcccctgcctgggccctgacttcagctccctgtagtgaagtccaggagggtgggacaggcctgtcaggcctctgggaatctcccaaatcccagaactcaccactcaccatgggcctttaaatgcagtaaactccacctaaccagattcaggggcactatgcccactgcctcctcttcagactctttgcatttcagtgaagagcctggaagaaacccaggggcctcctatgcacagatcttgcagcccagaaccaagtcagcctccctgcgactgcccaggcacactgcccaccaccccacccccgaaacaatgccagcccgctgctttttctatcctcccagtcacctttgcagacaaagaccaggggcagctcccgagggcactgtgaaggctcccatgccacacagtgagaactgtagcctctgcgtccaaggcacacagggtactttctggacccactgctggacagacttgaaggtgtcatgcccggtgtgtgcaggaggaaactaacagttcagtaaactctgccttgaccagca

SEQ ID NO: 348384 - DNA, 992 bp, Homo sapiens
aagaactttaaaaatcacctaggtgtgggccgggcacggtggctaacgcctgtaatcccagcactttgagatgctgaggcaggtggatcacgaggtcaggagatcgagaccatcctggataacacggagaaaccccggcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaagggcgttactacaaggagacctctggcctgatgctggacgttggtccctacatgaaggcgcttgagtatgcctgtggcatcaaagccgaggtggtggggaagccttctcctgagtttttcaagtctgccctgcaagcgataggagtggaagcccaccaggccgtcatgattggggacgatatcgtgggcgacgtcggcggtgcccagcggtgtggaatgagagcgctgcaggtgcgcaccgggaagttcaggtcagtgccagctggagtcatttattcaccttccttccaggggatgaccacattctcattctgttttgttcttcaaaataaaggggatattctttccaaatcaaagagcag

SEQ ID NO: 348385 - DNA, 792 bp, Homo sapiens
aagaactttaaaaatcacctaggtgtgggccgggcacggtggctaacgcctgtaatcccagcactttgagatgctgaggcaggtggatcacgaggtcaggagatcgagaccatcctggataacacggagaaaccccggcggagctgaggagcagggccgggcgccatggcaccgtggggcaagcggctggctggcgtgcgcggggtgctgcttgacatctcgggcgtgctgtacgacagcggcgcgggcggcggcacggccatcgccggctcggtggaggcggtggccagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcgaggcctgcgaccatacctgctcatccatgacggagtccgctcagaatttgatcagatcgacacatccaacccaaactgtgtggtaattgcagacgcaggagaaagcttttcttatcaaaacatgaataacgccttccaggtgctcatggagctggaaaaacctgtgctcatatcactgggaaaaggcatccacgggttcctctttgtggctagaacattcacgtcctaagtggggctgccgttggctgggttaaaccagtaaccagtaacaggagaaatacgtcgcatctctagtgtgtggagattaccgggcctttatattaaaaaaaaattttaagtgcttata

SEQ ID NO: 348386 - DNA, 573 bp, Homo sapiens
gcaggaatatggaagtcaaaggctgaaagatgaataggctctagcagatgaccagcatggataagaagaacccaggaaaagggaatggaatatgcaaggcacattcaagagtactgaagtggaaaatcaagaatatactgagttactgatgctaatagccaaagtgataactaaaagtaagtaagaaatcatgctgtaagtcagcttaagggggtactcctggttttaaaacaggtgctgtttttctcaaaattggagtggaaatttgactataggtgtggtagagggatacaaggttccataaactggcagatgcaattatagaatggatatgtgcatctcttttgctttaatttttattgtaggtagtttctttactcattttttgatagttgactaattccaaattttataataattataaaaataaaagtgaggaagcttttctctgtgttttataatcacttaaaatatttatagacatttcttctaaggcacaaaaatatttactttttttattgcctatgtataagtttacaggacttatttacatattctttgtggactctcagc

SEQ ID NO: 348387 - DNA, 1304 bp, Homo sapiens
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgaggtaagtttctacatgaataaaatcgtactagaaaggtgtgtgtgtgtgtgtgtgtgtgtgtgtgtgtgtgttgtggcttgttaatatgatggaaggtagtattatacaacataccagatttcaccatatttttacaataaaatttttattatatcttaagccttagcagtgagtggagaatatgaagtttaggtttcagtgggaatgggaagcagaggttgtgttcccaaggaaggaacagaggctggaaaatacactaagtcatgccattcgcctgctagcagagttttcagtggtatagtttagttaaaggaacagagtgtaaatgcagtg

SEQ ID NO: 348388 - DNA, 279 bp, Homo sapiens
gcggccgcctactactactactactactactaaattcgcggccgctcgacctgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatg

SEQ ID NO: 348389 - DNA, 585 bp, Homo sapiens
gcaggaatatggaagtcaaaggctgaaagatgaataggctctagcagatgaccagcatggataagaagaacccaggaaaagggaatggaatatgcaaggcacattcaagagtactgaagtggaaaatcaagaatatactgagttactgatgctaatagccaaagtgataactaaaagcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggtaaaaactaaacctatgtgtttttttttaaactgtgttaaattagccctatgtcattagaaatgttaacaagagcataactattttcatgatatggttattgtcaactgacatgttttttttttctttcaggtatattaaataagttcattgtgcttattat

SEQ ID NO: 348390 - DNA, 5061 bp, Homo sapiens
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgttttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaagaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacataaaaaacaaacacaaaaacaaacaaaaaaacaaaagaaagaaagcaaaagacagag

SEQ ID NO: 348391 - DNA, 4910 bp, Homo sapiens
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgttttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaagaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatg

SEQ ID NO: 348392 - DNA, 5007 bp, Homo sapiens
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgttttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaagaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacataaaaaacaaacacaaaaacaaacaaaaaaacaaaagaaagaaagcaaaagacagag

SEQ ID NO: 348393 - DNA, 5006 bp, Homo sapiens
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagttccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgttttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaagaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacataaaaaacaaacacaaaaacaaacaaaaaaacaaaagaaagaaagcaaaagacagag

SEQ ID NO: 348394 - DNA, 4090 bp, Homo sapiens
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgttttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaattttttacctggtggcggacacggttcggccacagcgggccagtttcgggaatttcgcataaaaggttcggcttaaatccaattg

SEQ ID NO: 348395 - DNA, 3665 bp, Homo sapiens
actatgtctcttctgggtacttcaacttttgtaggattaagcattagttaaaatttagttatagtgtgaatgttctttggattttagtaggacattcagtaaattatttcttgcatatactggtatacattctgcctaccattagaacccagagtgtgtttaaattagtgtcctaaattaattacattttttttctgctgtgtgtttctattaggtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgttttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaagaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacataaaaaacaaacacaaaaacaaacaaaaaaacaaaagaaagaaagcaaaagacagag

SEQ ID NO: 348396 - DNA, 967 bp, Homo sapiens
actatgtctcttctgggtacttcaacttttgtaggattaagcattagttaaaatttagttatagtgtgaatgttctttggattttagtaggacattcagtaaattatttcttgcatatactggtatacattctgcctaccattagaacccagagtgtgtttaaattagtgtcctaaattaattacattttttttctgctgtgtgtttctattaggtttcagaaaagggatccctaacatcagaagagtttgctaagcttgtgggaatgtctgtcctcctagccaaagaaagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacataaaaaacaaacacaaaaacaaacaaaaaaacaaaagaaagaaagcaaaagacagag

SEQ ID NO: 348397 - DNA, 5903 bp, Homo sapiens
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgttttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaagaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacataaaaaataaaagaaaaaaagaaaaaaaaaaaagaacaaaaataaacaaatggatggcgcaagtcccacaaaaatctacctccccgagggccacgagcagacacagccagacacaactcttgcgcacagcaaggggcgcccaatcagcacgtaacctttaataacagcaggcgaaccgcggacgcctccttcacacgacggctgaaggtgggcaaccaagcggcaacccacgaccttggatgggaagagacccacctactgcaggcagtgccgagaccaccacttcggggcaccgcatcgattcacacagaagtaggatgacacccgccgcaagtcaggcaacaatcagaaccgagccatacgccggtgtgatttacggggtggacccccacaaggacacatggtcccgccgcaaccagacaagaaagataagaccgcaagcgaacgccaaggaggcacgaagaaaccaaattagacccgcgccctcgagcgtaaataaaatccacgtacacagcgcaagccctgagaaaggtcgagaaaaaagagcacgacaaaggaaagcctccaaaccagaccgaaaaccagcacgacgagctagccacaggcgcaatcggagaaaggaaacaccaagtgacaggcgcacacagatagcatcgaacgacaaacagaacacgacgacaaagacgacgacggcagaaaagacaacccaagaaggaggaaacacaagaagagccataacaatgaaccaatccaccacagcaaacacaagaaaacagaacaaaagaagagagaacaaaaaaagaaagaaaacaccaacacagacaagacaagaaaaagaacaaaggaaacacacacacagaccccagacagaaaacaaagagaacaaaacgaggtagtac

SEQ ID NO: 348398 - DNA, 5629 bp, Homo sapiens
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaaggtagggcgtctgccaaccttcccaacgggctggcggaagggacccccggtgggcgcgcggcccggctcagcgcggcccgggtcggcgcggcccggtccccggcttagctcacggccctcggcggcccggcaggcctctgtgcggggtgcagcgctcttgcgctccccgccggtcggtagcacgtggcgtggggcgctcggctgcctccccagcgcgggtcccaactttggcacggttcccagcaggcgcggatcgcggccgcttccctccgcccggaatgcttccgggagcgcacagctgcagtgcccgggagaaggagcgctcgccgtctgcgggcgccgggcggcgatccggcagtcgacttccttggcgtggttccagaccccctgacgacaccaacctcggcgtcggcaccggacagccccgtttcgcctttctgtgaggagggcgcggtggccgtacagtccgtgccccagcggaagctttagcttggaccttatgcagtcggagggattagcatatctgggcagaggggtgagggattgcttcgaaaggatttcctaaagagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcaggctccgtgtgtttgacagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgttttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaagaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacataaaaaacaaacacaaaaacaaacaaaaaaacaaaagaaagaaagcaaaagacagag

SEQ ID NO: 348399 - DNA, 5043 bp, Homo sapiens
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagaggaacgagggggaataatgtcactcacggaggtgtactgcttagtaaaccgagctcgaggaatggaattgctctcaccagaagatttagtgaatgcgtgcaagatgctggaagcactgaaattacctctcagtggcgtcatggtaattgagcttcagtctcacaaggaagaggaaatggtggcctcggccctggagacagtttcagaaaagggatccctaacatcagaagagtttgctaagcttgtgggaatgtctgtcctcctagccaaagaaaggttgctgcttgcagagaagatgggccatctttgccgtgatgactcagtggaaggcctgcgtttttacccaaatttatttatgacacagagctaagggttttgtatttaaaatcctttttgtccatatgcttgcgtcatgtagaggttgtatgacattgagctaagagataaaccccgatcaattgagaatttattggaacttcacagtgcaatgtaaatctcttttaatttctcactaaatatggtccaggaaatttatttagtatacgcataggaaaattcagaaaagtgaatgccaatatgaatttaaaatcatgctatagtgcagaaccctcagagtttaacttggaatatagtggattttaacttgatcctcaaatctaatcattttataaagaagggaatttagttttgcagagaataaaaagagaagttgcatgttcagacaggttagattattattttggtgtaactgaaattcactgattgcacatgacaatgttgggacaaaatatactgcagcatgctatatgaggctcctccccagggcttttagaagcagtcatagacatgtcttcaacataccaaataaaatacctttaaaaatgaaataattttatttgacacatatatttatatatattctatctagtttctctttgttttttttaagtgatgatttcatgactggcatttaaagaatgcaactgtgtcattttgtttccaaatgctgtggattttgaaactgaactagagagctgtatagacatgcccagagttatgattacaaatttaggaggtagacggctcaggaattccctgggattgttgtgctggtggaatggcagagggaacttcacaggaaccttagtgttcttttacctcaaagccacagacaggaaatagaaagtggaaaagtaatatctccttttcttttccataaggagtttcaacactgaactttaaaaagtctatcatattccagcaatattttttctttgtcctttatgttgtaagttgtgtggaaaaactacttcggtaagaaatgttactgagataacaacaactggctaatactgcatgtagattgcttaggttttaaagtgactgcctgacttcacatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaagaatgggacatgtcatgaactggtttctttttttaaaaaattcttgatgtgaattccactgttacctgaccatgtatattcagatgaatgtactctttcttgttccttgttaccagattaatctgagagaatgtggattcatcctgtcatctttctcatactcaaatacttaaaatggttcttttgcccaaaagtctcagagtcttcattttggtacagtggagtcacaacttgtaaggtggttaggttttaaagaccgtgcctaaggacaaaattgagcatgctcagaatggtccttgaaaatctcctaaattaccaataaatttctctttgtagtcttaaagtttaaatccctgtggagtgatatgtaggtatgaatatattatgcttatattaagtacaaaaatacaaactgcatatcaagagattcttatagcattaataatttccatgcatgtgtctttttccagtaggtatggttgaatttatgtaaatttattgctaatcccatcccttacgatctagagtataagctgcgcaagggcagaagtttttatctggtttgttcatggatgtattctaagagctgagaacagggcctggacacaataagcattcaataaatatttactgaatgaatgaactcctacctatattcctatttataatttggctccactttatcctactttagctcccattcaattcaataaaaaaaacatttttttgaacacataaaaaacaaacacaaaaacaaacaaaaaaacaaaagaaagaaagcaaaagacagag

SEQ ID NO: 348400 - DNA, 1700 bp, Homo sapiens
  misc_feature (1479)..(1479): n is a, c, g, or t
  misc_feature (1699)..(1699): n is a, c, g, or t
gtgggtacataggtgtatatatttctggggtatatgggatattttgatacaggcatacactgtataataatcacatcagggtaaatgaggtatccgttacctcaagcatttatcctttgtgttacaatataatcttaaagggaaaaaaagagcagcacaggtagtactgactgcagctgtacagaaacaatgcgtgccataaatattcatttgaaagagaggggttatgattatttacaatcattagcgaatgtagcaacattctgggcactgacaagaaaactgccacaaacatgcaggcataatgcacaataagcaagtccaagctgtggtcggggctccctcgcgtccctgtaagctctgaatttagaatggggtggaccgcctgctgatcaagggttctgaaaggccggcggctaatggaccgccagggggcgctccacgcacgtctccacgtccccgggcgcacctcgcagccgcgcccgctcgctgccaggccgctccctccgtccctcacccgccccgactcgcttccgtcccgtccgacgctagggggcgccgcaggctgcctggcgcgctgctagcgggcctcggagggccggggctgggtggcagcggccatggaccgcttcgtttggaccagcggcctcctggagatcaacgagaccctggtgatccagcagcgcggggtgcgaatctacgatggcgaggagaagataaaatttgatgctgggactctccttcttagtacacaccgactgatttggagagatcagaaaaatcatgagtgttgcatggccattctcctttcccaaattgtgttcattgaagaacaggcggctggaattgggaagagtgccaaaatagtggttcatcttcacccagctcctcctaacaaagaacctggcccattccagagtagtaagaactcctacatcaaactctccttcaaagaacatggccagattgagttttacaggcgtttatcagaggaaatgacacaaagaagatgggagaatatgccagtttcccagtcattacaaacaaatagaggaccccagccaggaagaataagggctgtaggaattgtaggtattgaaaggaaactggaagaaaaaagaaaagaaactgacaaaaacatttctgaggcctttgaagacctcagcaaactaatgatcaaggctaaggaaatggtggaattatcaaaatcaattgctaataaaattaaagacaaacaaggtgacatcacagaagatgagaccatcaggtttaaatcctacttgctgagcatgggaatagctaacccagttaccagagaaacctacggctcaggcacacagtaccacatgcagctggccaaacaactggctggaatattgcaggtgcctttagagttgctctcaccagaagatttagtgaatgcgtgcaagatgctggaagcactgaaattacctctcagctcgtgtgtgacggggtcgntaatgaccttcgtctccaggaagaatggggccgccggaaggtcgaaaggcctacttgagagtgtagtggggagtggcccaaccagagggggtcggaaaggccttgccgggccgaggcgggtcccatttgacaacgggggtgaccggcggcgtgggggaggggacacaccaataattctctatatagaaacatcaccacgggaaaaataattaacactatnc

SEQ ID NO: 348401 - DNA, 470 bp, Homo sapiens
  misc_feature (421)..(421): n is a, c, g, or t
  misc_feature (455)..(455): n is a, c, g, or t
  misc_feature (464)..(464): n is a, c, g, or t
tctgcataacgcatttactaatattttctaaatgagcaatgtaggctaagaaaaaatcatgcataagtaaaagatccactcaaagtacaaggtaggtcaatagatcttaatgtaactgcatgtgaacaattcactaacatgattttattttttcacattgtaataatttttttaaaaaattaccacttgttgaatgttggtagagttttaaaaaaagaatatccaaaattatctgaaaaggctactaaaaatatttcttccttttccgactatatgcatatgctaggactgatttttgtatgacaatagattgagtgaagaagaagatatgaggcctgggagcagtggttctctgttggtccattaactacggggtggtttccaacacccttcaggggttgccatgaggtggcacaaagangctaagttggaactgtggatggcttcgctgggantctaggacngtggtt

SEQ ID NO: 348402 - DNA, 459 bp, Homo sapiens
ctccaccagggtcaaaaactgctttttcacgtcaaatggtgttggttttataattttatggaaactgaaggggactagctgaagttatttattactttccagcagctaataaatgttggtgtttaatagctgctgctctttaatatgggggtattgaataacttacataaaatatgttagcaaaacttgaaaaagttaaagcactgtccacttcttatggacttcttggccatttcctctcctttctcttcccctaaatgggaatggactgtaggtagacctcatgagtataagtctcagatgtccattatgttaccactggaaccatttagattagaagctgatcttcagtaaatatatttacattatccagtttgatcagataggtattatactacaacataaaacaaacagaagaatattatttatctcaaatatcaggtctttttaaaaaaaaaa

SEQ ID NO: 348403 - DNA, 618 bp, Homo sapiens
gactaattcactccagttcttgcactaattcactcactcgcttcctcccgtgaggagtttggagtggcgggctgagtaaatgaggcacccctgtcacgagtcctgtgaaggggtcggggaaatatcctgctttggtaacaacgacttacattcatacagcttctcacggtttgccagatgtttgcatattcattatctcatttgaccctccctcatcatcaccctgggacatacagaaggttctgtcatgggaggaggaggaacctccatgcttggccactgcctccctcccatgctgagtcctctccctgagtgggatgtcatgacgcagcccgtgtgtgcctatagcagaatgagatttcagcatagaatgactgacagcctaacaaccaggtaccttacttcttcttaaggaaaggcagagaataaaatctgtccagaggaaaatgactgttttatcactggtcatgagccttgatggcctcgtaagactcaaataacctaagctaaggccaagaacctgggcctgtgaggggagggttggaaggtgggcagggaatttgaactgcatgtatgttggataggtagcctctcggtggcttcatctgcagcactgcc

SEQ ID NO: 348404 - DNA, 180 bp, Homo sapiens
tggagagagaaggccatgctctctgccagaggtggagctgctgtccccaccccaccccccttggcactttcaagagcaggggtggccctggctgaggtctctgtggagcacatggtctgtgttgctggtcacctgtgcaagtagtgtgcagcggcctgagaaaatgaacaggcatagcca

SEQ ID NO: 348405 - DNA, 366 bp, Homo sapiens
tatattgtctcctgagcctaggataagctataattgattttctctaaacagtcctaagcactcaggcttaacttttcaagattcataactactaggactataaaataggagaagaaacttgaattgcaggagaaaaaaaatcctttgtaaaatggatctactctttttattgcattaagtatttacaaagaactaaattaagtaactgtgatttactgatgattaaagtttaaaaaaactgatcgggcaaaagaaaggatgaaatgaaaaatcgtgcaaaggaaaaagccagtttctcatgtaatgggagatgtcctttctgttggatctttgaagtctgattttcttcacaagaatccatcaagg

SEQ ID NO: 348406 - DNA, 425 bp, Homo sapiens
tgctcatctttatattccttagaattgagcagagtgtccatcccatggtaggcactcacgaaaatgtataaaataaaataaataaacataaaatcatctccttaagatccttcactttaacagatatgaaaactgaaggccgggcgcagtggctcaagcctgtaatcccagcactttgggaggccgaggcgggcggatcacgaggtcaggagatcgagaccatcctggctaacacagtgaaaccccgtctctactaaaaatattaaaaattagccgggcgtggtggcgggcgcctgtagtcccagctacttgggaggctgagccaggagaatggcgtgaacccaggaggtggaggttgcagtgagctaagatcgcgccactgcactccagcctgggtgacagagcaagactccgtctcaaaaaaa

SEQ ID NO: 348407 - DNA, 416 bp, Homo sapiens
agatgaggaaaatgaatatcgagatctgtgaatcccacccagtgccagccgccctgacatctttcctcttcatgtcacagaattgtcatgaggaccaatggcatcgggcagcagaaaacattgcatattccccaaaagaaagtggcccctgggctttcctttgcttccttcccagagtgagccatgctctggaagggatatttccatagctgtcctcttacagcatcagtaagcaccatgactttcaggagtacaggattgcacctttgacggctccaggcccacaaccgattgcattcctagaccacagggaagggcagcagatcactgcctcatctgcccagagctgtggaggcagcaaagggtgtttaacctctgctggtgaattgaaagcccaggagctggtgcagattcat

SEQ ID NO: 348408 - DNA, 503 bp, Homo sapiens
ctactagggaggatcacctgagcctgcgaggtcaaggctgcagtgagcctagatcacaccactgcactccagccggtgacagagcaagaccctgtctcaaaaaaaaaaaaaaaaaagtattaaaatataaaagttgggctatttctgtgtttataacacctttccttaatgagaggtgaatttataggctgtgtcttcaaaatgtataataattgaacccaatattaaatataataccagactcatttctcctctatttgagcatttatctctatgaactttaatctatagccatttaaactgctaatatttaaatatacccaaattatttcctgtaaaattatgggaaattattgttttttaatattttaattttttaacttgttctttttgaaataattttagacttaacaaaaatattgcaaaaatggtaccaaaaaaatccattacacctttcatccagattcctcaaatgctaacatcttacataattaccgtataat

SEQ ID NO: 348409 - DNA, 410 bp, Homo sapiens
atgaaccagaaaagagaaatcttgcactgattggaatatggcagccactcaccatctcccctgtctgctctcactcagtttatgtgacccaatgggaatggagaatctcaggcataaaaccaactgcttcgtgggttactctggaaaattctaaactgaagctttttgagaaaggcgacattacctcagaacttccacatgtagctactgtggagtttctgtttatgtgaatggatattttcaccagatattggaaacatgctgaagctggattccagtgcaataaaggcaactcatttagccattggcctgtgatactatgagaaatacagttaaattagacgaatgctccaccaggaattgtggccaaaataaatgatcattttttaaaaaagaaaaagataaagaca

SEQ ID NO: 348410 - DNA, 4407 bp, Homo sapiens
agtcgctctaccagtacctaagatggccgccggcccatccaccgtcgcgatcggtgtgaggaaagtgtcacgaacccggaattgcccgactccgtcatggcaggcgccgggggcgtggcttccggcggccacagcttgctagtcgccgcggcggggtcgagcgggggcggcagctgacaggcgctcctcccccgaccgcagcggctggttcccagcgaggcgggcggcccccagctcgcgtccccgagtcctagcccgcgaggcgccagggctgcgcctgggcatggaagaggggaagatggacgagaatgaatgggggtaccacggagagggcaataagagcctggtggtggcccacgcgcagcgctgcgtcgtgctgcggtttctgaagtttcctccaaataggaagaagacctcggaagagatatttcaacacctgcagaacatagtggactttgggaaaaatgtcatgaaggagtttttgggggagaactatgttcattatggggaggtcgttcagctacctttagagtttgtgaaacagctttgtttaaagatacaatctgaaagaccagagtctcgctgtgacaaggacctggatactctcagtggttacgctatgtgccttcctaatttaaccagactccaaacctaccgctttgcagagcaccggccgattctgtgtgtagagattaagccaaaatgtgggtttattcctttctcgagtgatgtcacgcatgagatgaagcataaggtctgtcgatactgcatgcaccagcacctcaaggtagcaactgggaagtggaagcagatcagcaaatactgtccccttgatctctactcaggaaacaaacagagaatgcactttgccttgaagagtttgctgcaggaggcacagaacaacttgaagatatttaagaatggtgagctgatttacggctgcaaagatgcccggagccccgtggctgactggagcgagcttgcacaccacctgaagccgttcttcttcccttccaacggcctggccagtgggccccactgcacaagggctgtgatcagggagctggtgcacgtgatcacacgggtgctgctgagtggctcggacaagggccgggcaggcaccctgagtccggggctcgggcctcagggcccgcgagtctgcgaagccagccctttcagtaggagccttcgctgccaaggaaaaaacaccccagagcgctcggggttaccgaagggctgtcttctgtacaaaaccctccaggtgcagatgttggacctgctggacatcgaaggcctctaccctctgtacaaccgggttgagcgatacctggaagagtttcccgaggagagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactggaacttcccccagctgagttacatggtcactttttcagtgcaagccacatatcaacacaggtttttaggtggttccctgctgcacagcgtgacctcgtggtcgcgcagatgccgattctgagcagtgtagactcagggtccctgtggaggtgctgaagcccacagttccacacagggcagcagggagcgcaaggctcaggtcaggatggacaccactcatgcgagcattgacctttttttttttgctttacaatttaatctttcacatgagggggagatgagctgttctttcccactaaaaattgctgctgtagaagttggaggtggagctgtgactggctgagctgctgtggccgggctgggcagtgtgccccaacagctcagtgctttcctgacactccagtgtctggggtggttgaggagcgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttgaatcaaggcaactcttctagaatttattgttcaattctgtcatatttacttctaattctactctcagaggtgcaaaaagatacttatctaactggacacttttactgttttcttctcacttccaatgacaccgtctcatacacacgggtcctgtgtgctgggatgggggctttggtgaagtgcacggagctcacggacaagccgcaggctctgggaagcgtggaggtagtggccgttgagtactgtcttgacccaagggagttcactgttgctgggctggggctggggcagcctggtttgggatgattttgcccattgtcacggtgtgtggaggatgctgggtcctgggttcaagtgcacatgtgagggaaccccagtccgtgggaaggtgggctgggctccctaggtccttcagggctgcaagagttattgcctagcacagggcccagacagggctggactagacacgatgaaaacagcctgtatttgagggagaagagaaaacagatggagacccccactctgtctggtcttggctcccaccagcccgggctgtgaggagcccctgagccgcgggtgccactgctgtggatgcgtttctggcccgtcttggaaactgctgctgctgcgtagtcatgacggccctgactggtttgagacaacacgcgttcacagatcttaacaatgctaaatgggcgactgatgaggtcacggttcttaaggcacatccgggacgatcgatatagcacttaggctatgcaggggggtctttctttcataaaggacctcattccttgcgtcccagcccaggaacagtgctgtctttgctgtcttaggccattcttgttattaagctgacagcttcactttcttgtggaagaccaagaacagcatgaggacttgctgagactgcctcacggtgccaccatgcggaccggggggaggcagggagtgagggtgtggctcccctgggctactaaggacagtttaaagatgaggcgccataggcatccgtctccagagcccccaggaggcaggaaccaggataagggtggcttctcccagctgagtaatgtggccaccatgtccaaggtggactcggtgtgaggctgcagtgggtgggggatggatcctccccacacatctgaggacacacaaccacttggtacattttctcagatgttaagcttatttttataaaccgcattgtacgtgtcacttttatttggcattttatacttaactagctgtatttatttttcatgtcatgagagtttccatataatgtgccataactgcatagacagcacgtcttcagggtgtggtttctaagcagaaaatagcaaatgtttatattgaataaaattgcatgttcctccacgc

SEQ ID NO: 348411 - DNA, 1900 bp, Homo sapiens
tgtttatttttgtgaaagcgagagctatgccatctaaaacaatgcaaaccatatatgaaagtccaaagaaggaagaggagagagtgcctcacattctgctctgtagaggagacagttgtgagcattgtggtgcctgtccttcacctttctccctgcccgcgtcacacacatgtgcacatgtacagctttacgtatgtcgactctgacagtgtggtgtgtgttgagctgtccctggtcagtatggacagacccacatagcttggagcatgtgttgaagagtgtaaatgtcagagccagcgtaccgggtttgagtccctgccttgccattgacaagcagggcatgacagacaagtgatgtctgtgtctgttgcttgtctgtaaagtgggacgccggccgtgctgccctgttgggctgctgtgagggtggagcaagttaacacatgcacagcctgtagaagggtggccgtctgccgttgtctctggtggctgtatgatgttccggagggaatgtcgttctaagcgatgccttgctgaacaccccctgcgctctccttgcaggtgtcgagtgatactcacttgatactctgagtgtggccaacatgcggggctcaggtggcttactgcttttccttccaaaggccgactgtggtgaccttgctgaagacagatcatccgtctcagggtctggagtcggggtcccacactgcttgccgtgagaggtcagggggcggtgctggcctctgagcagccccgtggcactgagggctggcccaggtgctctcacagggcgacctcctgacgcccgtgctcaccgtggccctcgctcctaatcccaccctcaggttctgaggcaggaagcagttcccacacttggctactgggaaggaaggttgtgtgggggggcagaggcttcctgtgtgacctggagctgatctttcccgcccctgcaggtgcagcagtaccgcgtcgccatgactgccaaggactgctccatcatgattgcactgtctccctgtctgcaggatgccaggtgaggcccccactgcaaggcatgcagcctgggtctaacggggttttatggacagttggtgaattgttaataggatagttggtttccccatatttagagactccatggcggagtgacataacttccttggcctatgtgacatcatggggcttactaactctcgccctctagaagcttgtaattcagtcaaaagacagatttatggagaataacttaaaaggattgttagtacattgaaagttactgttttctaagaaaatactcccaagagctcagaaacaatgtggacagtgagctgcccattgcattccctcaaagaaagccagcccctgagatgtgtgggtacctgtggcccttgttcctcggtctcccacagtggcagcatggcgcacctgcctttttaccaccacagtcatttgaaagcctgtgaggcgcgcattcattctgcttcctcttctgaataaccagcctatgtgccgcccctctccctaatgtcactagttttgtccagtcccctctgtttctgggaattcgggatgaaactgataatctcatagtcgttagacagcatctccatcaccgatcttcaggggtgctaaaccctgcacccagtatttgcggaatgttccacattcttctaacatgtgttcctgggtcaagatgaccttggttgctggctgccagccactcactttcccggtgcttttgaactaaacagttcccaggattcctgttccctggcaggcacagaattgtttactttccaatatgaaatactgaggaacattatagggctaactgaagtagaaaaaaggttgttctatttagttgaaaactcctgttatcccctaaggaaatacctacagggct

SEQ ID NO: 348412 - DNA, 225 bp, Homo sapiens
accctccccagtgagagttccggccgtgggtcctctagcggagatgtttgtgtgatctgatgcaggaagtgttgttcccgctgggaggtgcaaatgaaaacagcttctggggccatttatgcctaattatcttgctgcactcattatcttgtagtcagtgatatgtctatttagaggtatgtgatttcttcctaaatatttttcctccttatttgtttattttac

SEQ ID NO: 348413 - DNA, 4998 bp, Homo sapiens
agtcgctctaccagtacctaagatggccgccggcccatccaccgtcgcgatcggtgtgaggaaagtgtcacgaacccggaattgcccgactccgtcatggcaggcgccgggggcgtggcttccggcggccacagcttgctagtcgccgcggcggggtcgagcgggggcggcagctgacaggcgctcctcccccgaccgcagcggctggttcccagcgaggcgggcggcccccagctcgcgtccccgagtcctagcccgcgaggcgccagggctgcgcctgggcatggaagaggggaagatggacgagaatgaatgggggtaccacggagagggcaataagagcctggtggtggcccacgcgcagcgctgcgtcgtgctgcggtttctgaagtttcctccaaataggaagaagacctcggaagagatatttcaacacctgcagaacatagtggactttgggaaaaatgtcatgaaggagtttttgggggagaactatgttcattatggggaggtcgttcagctacctttagagtttgtgaaacagctttgtttaaagatacaatctgaaagaccagagtctcgctgtgacaaggacctggatactctcagtggttacgctatgtgccttcctaatttaaccagactccaaacctaccgctttgcagagcaccggccgattctgtgtgtagagattaagccaaaatgtgggtttattcctttctcgagtgatgtcacgcatgagatgaagcataaggtctgtcgatactgcatgcaccagcacctcaaggtagcaactgggaagtggaagcagatcagcaaatactgtccccttgatctctactcaggaaacaaacagagaatgcactttgccttgaagagtttgctgcaggaggcacagaacaacttgaagatatttaagaatggtgagctgatttacggctgcaaagatgcccggagccccgtggctgactggagcgagcttgcacaccacctgaagccgttcttcttcccttccaacggcctggccagtgggccccactgcacaagggctgtgatcagggagctggtgcacgtgatcacacgggtgctgctgagtggctcggacaagggccgggcaggcaccctgagtccggggctcgggcctcagggcccgcgagtctgcgaagccagccctttcagtaggagccttcgctgccaaggaaaaaacaccccagagcgctcggggttaccgaagggctgtcttctgtacaaaaccctccaggtgcagatgttggacctgctggacatcgaaggcctctaccctctgtacaaccgggttgagcgatacctggaagagtttcccgaggagaggtgaggtcgggcggtccccctgttgggcagccctgagaggagactgtgggagtgggcagggtaagaatgcgcctcccaaggcacagcttcccaggaggatgaagcatgccggccacttcctaccccagtcctccgctcccaggtgcccaggcctgctctggaatgtagtgccttgtaaaggaggaacagggtcacttgtttctagaaaagaaagcacgtctgtgaccttgctaattcgaaaccccagcctctgtcctgggctttcactgcgggtcattggggtccacacccgcggtgtccagtcggggccaggatcctcttccttcctcgctggtcttccttgcatctctgacgcaggatgctacttgtcatgaacaggagaaggctcagcttcaaggctcgctggttctggtcttgctgagttctgttaaaaaccttgatgtttaacatgagggagatagatctgttatgtgtttttcaaaacaaaatgtgtgatgtttagtggtgctgggctttgtagactgttagcagtttaagaaacaacctccgtgcggctttgtcatcctgtttttattgtgctttcttcttcagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactggaacttcccccagctgagttacatggtcactttttcagtgcaagccacatatcaacacaggtttttaggtggttccctgctgcacagcgtgacctcgtggtcgcgcagatgccgattctgagcagtgtagactcagggtccctgtggaggtgctgaagcccacagttccacacagggcagcagggagcgcaaggctcaggtcaggatggacaccactcatgcgagcattgacctttttttttttgctttacaatttaatctttcacatgagggggagatgagctgttctttcccactaaaaattgctgctgtagaagttggaggtggagctgtgactggctgagctgctgtggccgggctgggcagtgtgccccaacagctcagtgctttcctgacactccagtgtctggggtggttgaggagcgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttgaatcaaggcaactcttctagaatttattgttcaattctgtcatatttacttctaattctactctcagaggtgcaaaaagatacttatctaactggacacttttactgttttcttctcacttccaatgacaccgtctcatacacacgggtcctgtgtgctgggatgggggctttggtgaagtgcacggagctcacggacaagccgcaggctctgggaagcgtggaggtagtggccgttgagtactgtcttgacccaagggagttcactgttgctgggctggggctggggcagcctggtttgggatgattttgcccattgtcacggtgtgtggaggatgctgggtcctgggttcaagtgcacatgtgagggaaccccagtccgtgggaaggtgggctgggctccctaggtccttcagggctgcaagagttattgcctagcacagggcccagacagggctggactagacacgatgaaaacagcctgtatttgagggagaagagaaaacagatggagacccccactctgtctggtcttggctcccaccagcccgggctgtgaggagcccctgagccgcgggtgccactgctgtggatgcgtttctggcccgtcttggaaactgctgctgctgcgtagtcatgacggccctgactggtttgagacaacacgcgttcacagatcttaacaatgctaaatgggcgactgatgaggtcacggttcttaaggcacatccgggacgatcgatatagcacttaggctatgcaggggggtctttctttcataaaggacctcattccttgcgtcccagcccaggaacagtgctgtctttgctgtcttaggccattcttgttattaagctgacagcttcactttcttgtggaagaccaagaacagcatgaggacttgctgagactgcctcacggtgccaccatgcggaccggggggaggcagggagtgagggtgtggctcccctgggctactaaggacagtttaaagatgaggcgccataggcatccgtctccagagcccccaggaggcaggaaccaggataagggtggcttctcccagctgagtaatgtggccaccatgtccaaggtggactcggtgtgaggctgcagtgggtgggggatggatcctccccacacatctgaggacacacaaccacttggtacattttctcagatgttaagcttatttttataaaccgcattgtacgtgtcacttttatttggcattttatacttaactagctgtatttatttttcatgtcatgagagtttccatataatgtgccataactgcatagacagcacgtcttcagggtgtggtttctaagcagaaaatagcaaatgtttatattgaataaaattgcatgttcctccacgc

SEQ ID NO: 348414 - DNA, 3904 bp, Homo sapiens
tgtttatttttgtgaaagcgagagctatgccatctaaaacaatgcaaaccatatatgaaagtccaaagaaggaagaggagagagtgcctcacattctgctctgtagaggagacagttgtgagcattgtggtgcctgtccttcacctttctccctgcccgcgtcacacacatgtgcacatgtacagctttacgtatgtcgactctgacagtgtggtgtgtgttgagctgtccctggtcagtatggacagacccacatagcttggagcatgtgttgaagagtgtaaatgtcagagccagcgtaccgggtttgagtccctgccttgccattgacaagcagggcatgacagacaagtgatgtctgtgtctgttgcttgtctgtaaagtgggacgccggccgtgctgccctgttgggctgctgtgagggtggagcaagttaacacatgcacagcctgtagaagggtggccgtctgccgttgtctctggtggctgtatgatgttccggagggaatgtcgttctaagcgatgccttgctgaacaccccctgcgctctccttgcaggtgtcgagtgatactcacttgatactctgagtgtggccaacatgcggggctcaggtggcttactgcttttccttccaaaggccgactgtggtgaccttgctgaagacagatcatccgtctcagggtctggagtcggggtcccacactgcttgccgtgagaggtcagggggcggtgctggcctctgagcagccccgtggcactgagggctggcccaggtgctctcacagggcgacctcctgacgcccgtgctcaccgtggccctcgctcctaatcccaccctcaggttctgaggcaggaagcagttcccacacttggctactgggaaggaaggttgtgtgggggggcagaggcttcctgtgtgacctggagctgatctttcccgcccctgcaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactggaacttcccccagctgagttacatggtcactttttcagtgcaagccacatatcaacacaggtttttaggtggttccctgctgcacagcgtgacctcgtggtcgcgcagatgccgattctgagcagtgtagactcagggtccctgtggaggtgctgaagcccacagttccacacagggcagcagggagcgcaaggctcaggtcaggatggacaccactcatgcgagcattgacctttttttttttgctttacaatttaatctttcacatgagggggagatgagctgttctttcccactaaaaattgctgctgtagaagttggaggtggagctgtgactggctgagctgctgtggccgggctgggcagtgtgccccaacagctcagtgctttcctgacactccagtgtctggggtggttgaggagcgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttgaatcaaggcaactcttctagaatttattgttcaattctgtcatatttacttctaattctactctcagaggtgcaaaaagatacttatctaactggacacttttactgttttcttctcacttccaatgacaccgtctcatacacacgggtcctgtgtgctgggatgggggctttggtgaagtgcacggagctcacggacaagccgcaggctctgggaagcgtggaggtagtggccgttgagtactgtcttgacccaagggagttcactgttgctgggctggggctggggcagcctggtttgggatgattttgcccattgtcacggtgtgtggaggatgctgggtcctgggttcaagtgcacatgtgagggaaccccagtccgtgggaaggtgggctgggctccctaggtccttcagggctgcaagagttattgcctagcacagggcccagacagggctggactagacacgatgaaaacagcctgtatttgagggagaagagaaaacagatggagacccccactctgtctggtcttggctcccaccagcccgggctgtgaggagcccctgagccgcgggtgccactgctgtggatgcgtttctggcccgtcttggaaactgctgctgctgcgtagtcatgacggccctgactggtttgagacaacacgcgttcacagatcttaacaatgctaaatgggcgactgatgaggtcacggttcttaaggcacatccgggacgatcgatatagcacttaggctatgcaggggggtctttctttcataaaggacctcattccttgcgtcccagcccaggaacagtgctgtctttgctgtcttaggccattcttgttattaagctgacagcttcactttcttgtggaagaccaagaacagcatgaggacttgctgagactgcctcacggtgccaccatgcggaccggggggaggcagggagtgagggtgtggctcccctgggctactaaggacagtttaaagatgaggcgccataggcatccgtctccagagcccccaggaggcaggaaccaggataagggtggcttctcccagctgagtaatgtggccaccatgtccaaggtggactcggtgtgaggctgcagtgggtgggggatggatcctccccacacatctgaggacacacaaccacttggtacattttctcagatgttaagcttatttttataaaccgcattgtacgtgtcacttttatttggcattttatacttaactagctgtatttatttttcatgtcatgagagtttccatataatgtgccataactgcatagacagcacgtcttcagggtgtggtttctaagcagaaaatagcaaatgtttatattgaataaaattgcatgttcctccacgc

SEQ ID NO: 348415 - DNA, 4163 bp, Homo sapiens
cacgattccacaagcatagcatctgagtgaccctgggttgctcatgaccctggggtgctcgaccaaagccccaccagttgctggaatggtgagctgatttacggctgcaaagatgcccggagccccgtggctgactggagcgagcttgcacaccacctgaagccgttcttcttcccttccaacggcctggccagtgggccccactgcacaagggctgtgatcagggagctggtgcacgtgatcacacgggtgctgctgagtggctcggacaagggccgggcaggcaccctgagtccggggctcgggcctcagggcccgcgagtctgcgaagccagccctttcagtaggagccttcgctgccaaggaaaaaacaccccagagcgctcggggttaccgaagggctgtcttctgtacaaaaccctccaggtgcagatgttggacctgctggacatcgaaggcctctaccctctgtacaaccgggttgagcgatacctggaagagtttcccgaggagaggtgaggtcgggcggtccccctgttgggcagccctgagaggagactgtgggagtgggcagggtaagaatgcgcctcccaaggcacagcttcccaggaggatgaagcatgccggccacttcctaccccagtcctccgctcccaggtgcccaggcctgctctggaatgtagtgccttgtaaaggaggaacagggtcacttgtttctagaaaagaaagcacgtctgtgaccttgctaattcgaaaccccagcctctgtcctgggctttcactgcgggtcattggggtccacacccgcggtgtccagtcggggccaggatcctcttccttcctcgctggtcttccttgcatctctgacgcaggatgctacttgtcatgaacaggagaaggctcagcttcaaggctcgctggttctggtcttgctgagttctgttaaaaaccttgatgtttaacatgagggagatagatctgttatgtgtttttcaaaacaaaatgtgtgatgtttagtggtgctgggctttgtagactgttagcagtttaagaaacaacctccgtgcggctttgtcatcctgtttttattgtgctttcttcttcagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactggaacttcccccagctgagttacatggtcactttttcagtgcaagccacatatcaacacaggtttttaggtggttccctgctgcacagcgtgacctcgtggtcgcgcagatgccgattctgagcagtgtagactcagggtccctgtggaggtgctgaagcccacagttccacacagggcagcagggagcgcaaggctcaggtcaggatggacaccactcatgcgagcattgacctttttttttttgctttacaatttaatctttcacatgagggggagatgagctgttctttcccactaaaaattgctgctgtagaagttggaggtggagctgtgactggctgagctgctgtggccgggctgggcagtgtgccccaacagctcagtgctttcctgacactccagtgtctggggtggttgaggagcgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttgaatcaaggcaactcttctagaatttattgttcaattctgtcatatttacttctaattctactctcagaggtgcaaaaagatacttatctaactggacacttttactgttttcttctcacttccaatgacaccgtctcatacacacgggtcctgtgtgctgggatgggggctttggtgaagtgcacggagctcacggacaagccgcaggctctgggaagcgtggaggtagtggccgttgagtactgtcttgacccaagggagttcactgttgctgggctggggctggggcagcctggtttgggatgattttgcccattgtcacggtgtgtggaggatgctgggtcctgggttcaagtgcacatgtgagggaaccccagtccgtgggaaggtgggctgggctccctaggtccttcagggctgcaagagttattgcctagcacagggcccagacagggctggactagacacgatgaaaacagcctgtatttgagggagaagagaaaacagatggagacccccactctgtctggtcttggctcccaccagcccgggctgtgaggagcccctgagccgcgggtgccactgctgtggatgcgtttctggcccgtcttggaaactgctgctgctgcgtagtcatgacggccctgactggtttgagacaacacgcgttcacagatcttaacaatgctaaatgggcgactgatgaggtcacggttcttaaggcacatccgggacgatcgatatagcacttaggctatgcaggggggtctttctttcataaaggacctcattccttgcgtcccagcccaggaacagtgctgtctttgctgtcttaggccattcttgttattaagctgacagcttcactttcttgtggaagaccaagaacagcatgaggacttgctgagactgcctcacggtgccaccatgcggaccggggggaggcagggagtgagggtgtggctcccctgggctactaaggacagtttaaagatgaggcgccataggcatccgtctccagagcccccaggaggcaggaaccaggataagggtggcttctcccagctgagtaatgtggccaccatgtccaaggtggactcggtgtgaggctgcagtgggtgggggatggatcctccccacacatctgaggacacacaaccacttggtacattttctcagatgttaagcttatttttataaaccgcattgtacgtgtcacttttatttggcattttatacttaactagctgtatttatttttcatgtcatgagagtttccatataatgtgccataactgcatagacagcacgtcttcagggtgtggtttctaagcagaaaatagcaaatgtttatattgaataaaattgcatgttcctccacgc

SEQ ID NO: 348416 - DNA, 570 bp, Homo sapiens
attatcttgtagtcagtgatatgtctatttagaggtatgtgatttcttcctaaatatttttcctccttatttgtttattttacagccaaaatgtgggtttattcctttctcgagtgatgtcacgcatgagatgaagcataaggtctgtcgatactgcatgcaccagcacctcaaggtgagagccaatgcccagctgtgggctactctagctgcacgctggggatctgggctgaggcatggacacacacagttttcagaagagtaaaagaaaatatggatatttttagttgacattttatttcacaaagtgattcatgttcaacttttttattttttaaatttagagacagggtctctgtcaccctgtcaggctggagtgcagtgatgcaatcatactcactgcagcctccacctcctggactcatgcagtccacctgccttggcctcccaaagtgctggtgtgagccactgcgcccggcccgtgttcaccagattcactcttttaaatatataattcagttttagtctcttcacaaggttgtacaatcaccacttctatctagttgctga

SEQ ID NO: 348417 - DNA, 500 bp, Homo sapiens
actcctgacctcatgatccacctgccttggcctcccaaagtgctgggataacaggtgtgagccacctcacctggcctaaaccacgttgttactgtgtgtgtcccacaatccccagggagacatgaggttttcatcaggtacagagatgccccctggaaccagggacaaggcggggcctgttttgggcagggatcatctcatctctctcactgaccttgctctgtgtgacccttgctctgttttccagagtctcgctgtgacaaggacctggatactctcagtggttacgctatgtgccttcctaatttaaccagactccaaacctaccgctttgcagagcaccggccgattctgtgtgtagagattaaggtgacctgtcgaggggcagatggtgtgggtaaaggggaaaggtcagtcttgggtagtaagtccaagagtcacgtgccttgggttccagttcccactgaagtgagtggtaggcacccttggctcctggaaac

SEQ ID NO: 348418 - DNA, 3541 bp, Homo sapiens
agtcgctctaccagtacctaagatggccgccggcccatccaccgtcgcgatcggtgtgaggaaagtgtcacgaacccggaattgcccgactccgtcatggcaggcgccgggggcgtggcttccggcggccacagcttgctagtcgccgcggcggggtcgagcgggggcggcagctgacaggcgctcctcccccgaccgcagcggctggttcccagcgaggcgggcggcccccagctcgcgtccccgagtcctagcccgcgaggcgccagggctgcgcctgggcatggaagaggggaagatggacgagaatgaatgggggtaccacggagagggcaataagagcctggtggtggcccacgcgcagcgctgcgtcgtgctgcggtttctgaagtttcctccaaataggaagaagacctcggaagagatatttcaacacctgcagaacatagtggactttgggaaaaatgtcatgaaggagtttttgggggagaactatgttcattatggggaggtcgttcagctacctttagagtttgtgaaacagctttgtttaaagatacaatctgaaagaccagagtctcgctgtgacaaggacctggatactctcagtggttacgctatgtgccttcctaatttaaccagactccaaacctaccgctttgcagagcaccggccgattctgtgtgtagagattaagccaaaatgtgggtttattcctttctcgagtgatgtcacgcatgagatgaagcataaggtctgtcgatactgcatgcaccagcacctcaaggtagcaactgggaagtggaagcagatcagcaaatactgtccccttgatctctactcaggaaacaaacagagaatgcactttgccttgaagagtttgctgcaggaggcacagaacaacttgaagatatttaagaatggtgagctgatttacggctgcaaagatgcccggagccccgtggctgactggagcgagcttgcacaccacctgaagccgttcttcttcccttccaacggcctggccagtgggccccactgcacaagggctgtgatcagggagctggtgcacgtgatcacacgggtgctgctgagtggctcggacaagggccgggcaggcaccctgagtccggggctcgggcctcagggcccgcgagtctgcgaagccagccctttcagtaggagccttcgctgccaaggaaaaaacaccccagagcgctcggggttaccgaagggctgtcttctgtacaaaaccctccaggtgcagatgttggacctgctggacatcgaaggcctctaccctctgtacaaccgggttgagcgatacctggaagagtttcccgaggagagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccagctctgatcaaaggcctgtcgtcccttcatcgaggtccaggtttgccttttccgtgtctgtgctggaccttgacctcaagccctacgagagcattccccatcagtataaactggacggcaagatcgtcaactattattcaaagactgtacgtgccaaagacaacgccgtgatgtcgactcggttcaaggaaagcgaagattgcacattagttctccacaaggtctaactctttccctgcagtgtctttgaaacttgaacataatgtgaaggctgaatgatagagatattttctgttgtgttgggtgacctttggttgtgaatgtttttgcttttaaccccttttgaggtgggattgcctcttggagacatggaattgaagagcactagaaacaacttcctggacaaggaatgtaggaagtgagtgctgtgtcccaggaagctgctcacactcttaaaatggaagtgtccgttaagccctgggaagacgttctggatagttcttctttcccaaccagggctcatgtctgattctctaatgcgaaaagccttattctaagacccaaggtttggatctgctaccaccagactcctaacatagaaaacttgaattgtcacatacattttacagtttggacttttaagaaaacatggatactactggaacttcccccagctgagttacatggtcactttttcagtgcaagccacatatcaacacaggtttttaggtggttccctgctgcacagcgtgacctcgtggtcgcgcagatgccgattctgagcagtgtagactcagggtccctgtggaggtgctgaagcccacagttccacacagggcagcagggagcgcaaggctcaggtcaggatggacaccactcatgcgagcattgacctttttttttttgctttacaatttaatctttcacatgagggggagatgagctgttctttcccactaaaaattgctgctgtagaagttggaggtggagctgtgactggctgagctgctgtggccgggctgggcagtgtgccccaacagctcagtgctttcctgacactccagtgtctggggtggttgaggagcgagttctctcttcctcccagaccaagttcctccctcgggtttgccttgagacgtgttgcgtttttgggccccgtggcctctccctgttaggctgccacaggccctgcttctggaaggtgaacagctcctggctgctgccgagagggttctcgttggggtcaccaaagtgtgcccggctgctatgaaaaacgttgggaatcttggtttcagttttttattctatgctaggttgtacagacttatttatatcatcgttttgagggactaatggaggcttattgtaacatataatattagtgaaaccatggaattatatgaaaatgatacatgagaaataaggaaactattttgctgattgtaaatttttgtgggaaattttgtgataacttgagaattatacttgtttgaatcaaaaaaaaaaaaaaaaaaaaaaaaaaaaaaaaaaaaaaaaaaaaaaaaaaaaaaaaaaaaaaaaaaaaaaaaaaaacaaaagaagaagaagggggggggcgcggcctggaaagaatcatccacccggcgggaggagccccacacttgtacggagccaccaccgccgttttgttgaagaaggagggggggcgccccactcatgagaggagcgtcgtatttatcaaggcagcaggagcgggggggcgccgagcgtattaaaaagaacggtcggcagcgggagaaacaagaactagttggtacttggacaatctactttgtggggaaggagcagcacactctagaggggggggggagaaacattgttgagacaaaaccctccccagaagagttttcttgcccccgtgagggctatattaacctttggagggtctgtttgtgtggtaacccccgcgatagtatccgtgccgagaaaaattctcgccgccgaagtatgtgttaagaaaatatcaggga

SEQ ID NO: 348419 - DNA, 2994 bp, Homo sapiens
agtcgctctaccagtacctaagatggccgccggcccatccaccgtcgcgatcggtgtgaggaaagtgtcacgaacccggaattgcccgactccgtcatggcaggcgccgggggcgtggcttccggcggccacagcttgctagtcgccgcggcggggtcgagcgggggcggcagctgacaggcgctcctcccccgaccgcagcggctggttcccagcgaggcgggcggcccccagctcgcgtccccgagtcctagcccgcgaggcgccagggctgcgcctgggcatggaagaggggaagatggacgagaatgaatgggggtaccacggagagggcaataagagcctggtggtggcccacgcgcagcgctgcgtcgtgctgcggtttctgaagtttcctccaaataggaagaagacctcggaagagatatttcaacacctgcagaacatagtggactttgggaaaaatgtcatgaaggagtttttgggggagaactatgttcattatggggaggtcgttcagctacctttagagtttgtgaaacagctttgtttaaagatacaatctgaaagaccagagtctcgctgtgacaaggacctggatactctcagtggttacgctatgtgccttcctaatttaaccagactccaaacctaccgctttgcagagcaccggccgattctgtgtgtagagattaagccaaaatgtgggtttattcctttctcgagtgatgtcacgcatgagatgaagcataaggtctgtcgatactgcatgcaccagcacctcaaggtagcaactgggaagtggaagcagatcagcaaatactgtccccttgatctctactcaggaaacaaacagagaatgcactttgccttgaagagtttgctgcaggaggcacagaacaacttgaagatatttaagaatggtgagctgatttacggctgcaaagatgcccggagccccgtggctgactggagcgagcttgcacaccacctgaagccgttcttcttcccttccaacggcctggccagtgggccccactgcacaagggctgtgatcagggagctggtgcacgtgatcacacgggtgctgctgagtggctcggacaagggccgggcaggcaccctgagtccggggctcgggcctcagggcccgcgagtctgcgaagccagccctttcagtaggagccttcgctgccaaggaaaaaacaccccagagcgctcggggttaccgaagggctgtcttctgtacaaaaccctccaggtgcagatgttggacctgctggacatcgaaggcctctaccctctgtacaaccgggttgagcgatacctggaagagtttcccgaggagaggtgaggtcgggcggtccccctgttgggcagccctgagaggagactgtgggagtgggcagggtaagaatgcgcctcccaaggcacagcttcccaggaggatgaagcatgccggccacttcctaccccagtcctccgctcccaggtgcccaggcctgctctggaatgtagtgccttgtaaaggaggaacagggtcacttgtttctagaaaagaaagcacgtctgtgaccttgctaattcgaaaccccagcctctgtcctgggctttcactgcgggtcattggggtccacacccgcggtgtccagtcggggccaggatcctcttccttcctcgctggtcttccttgcatctctgacgcaggatgctacttgtcatgaacaggagaaggctcagcttcaaggctcgctggttctggtcttgctgagttctgttaaaaaccttgatgtttaacatgagggagatagatctgttatgtgtttttcaaaacaaaatgtgtgatgtttagtggtgctgggctttgtagactgttagcagtttaagaaacaacctccgtgcggctttgtcatcctgtttttattgtgctttcttcttcagaaaaaccttacaaatagatgggccttatgatgaagcattttaccagaagctgcttgacctttccactgaggatgacgggacagtggccttcgcgctaacgaaggtgcagcagtaccgcgtcgccatgactgccaaggactgctccatcatgattgcactgtctccctgtctgcaggatgccaggtgaggcccccactgcaaggcatgcagcctgggtctaacggggttttatggacagttggtgaattgttaataggatagttggtttccccatatttagagactccatggcggagtgacataacttccttggcctatgtgacatcatggggcttactaactctcgccctctagaagcttgtaattcagtcaaaagacagatttatggagaataacttaaaaggattgttagtacattgaaagttactgttttctaagaaaatactcccaagagctcagaaacaatgtggacagtgagctgcccattgcattccctcaaagaaagccagcccctgagatgtgtgggtacctgtggcccttgttcctcggtctcccacagtggcagcatggcgcacctgcctttttaccaccacagtcatttgaaagcctgtgaggcgcgcattcattctgcttcctcttctgaataaccagcctatgtgccgcccctctccctaatgtcactagttttgtccagtcccctctgtttctgggaattcgggatgaaactgataatctcatagtcgttagacagcatctccatcaccgatcttcaggggtgctaaaccctgcacccagtatttgcggaatgttccacattcttctaacatgtgttcctgggtcaagatgaccttggttgctggctgccagccactcactttcccggtgcttttgaactaaacagttcccaggattcctgttccctggcaggcacagaattgtttactttccaatatgaaatactgaggaacattatagggctaactgaagtagaaaaaaggttgttctatttagttgaaaactcctgttatcccctaaggaaatacctacagggct

SEQ ID NO: 348420 - DNA, 791 bp, Homo sapiens
aagcaatttatttacttatttaaaggctctgtcaggtattgcctaaggtaaaagtctgtattgtaagacagaaaacctctgcccaggacttcagtagctcagagagggaaaggcttgatatgtgtctgaaaagacaagttttagacagcaagaaaaaagagatccttcccatttcaactccttaccctcctctacccccaatgaaaacagaccttccttcgccttatccacaggctcctccaccaagccaaggccaggactcctgcaatcataggatggcaacaccacctctaaagcacagaacttcaggctttgcttcggaagtggcaccatggtctcttcattttccctttcttcaaggtcagaaaactgaagctgttaggagttttagtgttaagttccttccgaggatgttaattaggcttcaaactgttttgttctgagaaataaaaactaaactccagtcattcaagctaacagttgaggtgttctatggcttcaaaatcaagtaagatttgtaaatgaattgctaggtgcaaccattacttattatatgccacacaaacagtggagaaaattatggacaccaccatccaagtgattgagattattaattttaggtagcaggccaattcagacatgtccacttatcctcaatggcagggggcctctcacatcccctccctgtaacccagttcaatacttctgtctaaagtctagaatttcaatgttgaaaggagagcgtggttagtgagagaaaatccacaaagtttatcctgatgatcctttct

SEQ ID NO: 348421 - DNA, 994 bp, Homo sapiens
gagaaattcagaacctcaggcctaaacccaggcctactaaatcaggatctgcagtttctcacaatcttcaggtgatttctatggtcattaaagtttgaaaagctgcctcgaaacagtccttcctaaaactgaagtggaggtgccacaaaaatcatctggtaaattgtttaaagtaatcccaaatgcaactcaaatctacagaatcccaggtgaagctcagtaatctgtatttttatccttctccccaaataattctgatgtgcaggcaagtttgaaaaccactgctttaaagaaaatggatactccccttaccaagcagaaagtaggattttggaaactgatgcaagggaagcaaaaaagatgcctcaggaggcacgattacaacaggattgatgcaaacggaagctgaagcttaaccaaagacattaatatacgcccacaaaagaaaatgctaaggaagtcaagtggtctgcatgaattctgaagaaaaatggagaaccaaagaacaaaatttgtcaatgaacttccagcacagtctaggttaagggagtgaatttcttgactgaatggcacagactctgtaccacctgattggctgttaccttaatggaggaattatattacaatgtataggtactttaattagaatgacctggcagttactgaggcaaaattttccgctcctttgtattctgtaatacaagaaggatctacatggatgttctgttctctgaactgtctggatgaaccggtcaacggcactcatcataccttagtttttaaatctgcattgtggtcataatctgttatttaattaatttctcgtatttttaataaaaactttgcctatatatttagacagaaattgccttactttgctgaaatgctgagaaatcctagacagttttcaaggctgggctcaaatgtcacctctactaccctttgctgtgcctcctggcactgtgcttctgacactttgtacggtcctccatga

SEQ ID NO: 348422 - DNA, 2843 bp, Homo sapiens
ggcacgagggtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggttcgtgagccacacatctccccacaccaagctcctccatacaagacctcggactgcatcacgtaaatgctttttcaggggcaaaatctagagaatctgaaatgagctatcagcttcccagtttgcacaattcatcaagaaattatgcggggtcaccggcacaaatgatgaggcatctcctggaagcttaacttcttatccatcccatctcttggacagatgatgccagttaattactttgaatgctcctccaccaagccaaggccaggactcctgcaatcataggatggcaacaccacctctaaagcacagaacttcaggctttgcttcggaagtggcaccatggtctcttcattttccctttcttcaaggcaagtttgaaaaccactgctttaaagaaaatggatactccccttaccaagcagaaagtaggattttggaaactgatgcaagggaagcaaaaaagatgcctcaggaggcacgattacaacaggattgatgcaaacggaagctgaagcttaaccaaagacattaatatacgcccacaaaagaaaatgctaaggaagtcaagtggtctgcatgaattctgaagaaaaatggagaaccaaagaacaaaatttgtcaatgaacttccagcacagtctaggttaagggagtgaatttcttgactgaatggcacagactctgtaccacctgattggctgttaccttaatggaggaattatattacaatgtataggtactttaattagaatgacctggcagttactgaggcaaaattttccgctcctttgtattctgtaatacaagaaggatctacatggatgttctgttctctgaactgtctggatgaaccggtcaacggcactcatcataccttagtttttaaatctgcattgtggtcataatctgttatttaattaatttctcgtatttttaataaaaactttgcctat

SEQ ID NO: 348423 - DNA, 1574 bp, Homo sapiens
ttcaccatgatagagggcgtcttgcattggttcacaatggcctgttgctttttagccttcagttggtttagggggaaattgctcaacctatgagacctgctcaaattcatactgttctggttttgctttggaattctttgtccagtaaattagctcttcatacaaatcccatgagtgcatggagaggaagtggggagagctgaagatgctagcattaagatgctagagaaacacgagacaattgatggagcaagatatctaaggaagtagaatattaagagtgagatagtgttgaaacactgaccttgggaagaaagaagaatgccgcttccattaagactgaaagagaggaggaagaggtggatattgtggaagtagagaggaagctcataccagacgacttggatcatctcagtcaagaaggggcaacagaagaatcttgggccaggacaaagcataggagggtgaagtggaaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgagctatcagcttcccagtttgcacaattcatcaagaaattatgcggggtcaccggcacaaatgatgaggcatctcctggaagcttaacttcttatccatcccatctcttggacagatgatgccagttaattactttgaatgtaagtattttatctaaaagcacttatgtgtctaaacagacttctacaaatcagtaccaaaatggtaaataattccacagaaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacctcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatc

SEQ ID NO: 348424 - DNA, 716 bp, Homo sapiens
ggcactattaacttggcccggcccacatgtcccctcccggttggtgtgaacgctccgaggttagctcaaacctcggcgattttcccagctgattggccgtgcaaatagacaatccttttgcttttctgattggtcgcacatggcatcgggggtgggggacgtgggcgtgtctcgccagaattcgtttaactgtgatttgaagatgaacatggtattgccagagcttcatggcgtcgcctacggcgctccctccctcccaggcccttactcttctttgcattggccagatatgtcgtcactcacaaaacttcgagctcattggtgcaaaagctccaggaggcggtgggtgattggttggttgctgttcctgcccccacgcctgtcgtggtttagctgaactgagctgaaatcctaaaggccgcggagtcggcggtgttgtaggtagcggtaccttgagtggcaacaggtgagtctccggctgcagggatggggcggcagcactcaagacctggctggatctccacttcgtctgcgggccagaaactggagggcggcggtggctttcggaaagggattgggctccgctgttccttcttcgccctctgtagggccggagcagcgaggaaccgaaggaggcttcataggttccacgcagggccctctctttgctcttccaggggcgcacaagttgagaaggagcggcctggcagccgggg

SEQ ID NO: 348425 - DNA, 747 bp, Homo sapiens
gcctgcagaccgctcagctttcattccagtgaaaacattccagaaaaaactctgaatcaatcccaggtgtttctccaatcagctcaggatgattgtgtgttacctgctgcccagccagtgacacctctccaggcctctgacttagctaggtctccaccatgtgactccaccatagactccccaccttcttcttttgcaaagcctcagacacccaaacacctaccaaaagtgggtagggcaccaggacactccaagtgtaagtggggctctccagcacacctggatgtggaggtgtgatgcagagtggtggctgctcgtgacactcatttcacccctttctgtgcaggtcctatggactggacagttgggtaggaaccagaaggccaataggaaggaggacaaaagtgcccaactgaagggtaagcatggcagtgagtatggtatgcctagaataaagatggttgggattagaattgggtgacagtgattagtagtttcagaagtatctcttcccaattcaaaagtctcactttgggctgaaagtacagaggaagaaggtagacttttaagaagtctgaataagcccccaacttctggagtccctttctcaattcctgttgggagtgggaaatattataaattactctgggcattaaaaatagcttagtttaacctggattgcggagttaaaaaataacaaagactgcattggtcaaatctggacaatttgagcattcaaaagaataa

SEQ ID NO: 348426 - DNA, 516 bp, Homo sapiens
gcggccgcctactactactactgctcgaattcaagcttctaacgatgtacggggacatggtctcttcattttccctttcttcaaggtcagaaaactgaagctgttaggagttttagtgttaagttccttccgaggatgttaattaggcttcaaactgttttgttctgagaaataaaaactaaactccagtcattcaagctaacagttgaggtgttctatggcttcaaaatcaagtaagatttgtaaatgaattgctaggtgcaaccattacttattatatgccacacaaacagtggagaaaattatggacaccaccatccaagtgattgagattattaattttaggtagcaggccaattcagacatgtccacttatcctcaatggcagggggcctctcacatcccctccctgtaacccagttcaatacttctgtctaaagtctagaatttcaatgttgaaaggagagcgtggttagtgagagaaaatccacaaagtttatcctgatgatcctttct

SEQ ID NO: 348427 - DNA, 251 bp, Homo sapiens
gcggccgcctactactactactgctcgaattcaagcttctaacgatgtacggggacatgttggtcaggctggtcacgagctcctaacctcaagtgatcccaaagtgctgtgattacaggcgtgagccatcctgcctggcctttctggttaaaattctgtgaggtttgcataaaaggaatagagtaggggcccaaaaaccagtaagatgagaaaatagtgtttcctcagttctaggatccaggggaaaaaaa

SEQ ID NO: 348428 - DNA, 3754 bp, Homo sapiens
  misc_feature (1637)..(1637): n is a, c, g, or t
  misc_feature (1917)..(1917): n is a, c, g, or t
  misc_feature (2049)..(2049): n is a, c, g, or t
  misc_feature (2075)..(2075): n is a, c, g, or t
  misc_feature (3184)..(3184): n is a, c, g, or t
  misc_feature (3301)..(3301): n is a, c, g, or t
  misc_feature (3461)..(3461): n is a, c, g, or t
  misc_feature (3488)..(3488): n is a, c, g, or t
ggcactattaacttggcccggcccacatgtcccctcccggttggtgtgaacgctccgaggttagctcaaacctcggcgattttcccagctgattggccgtgcaaatagacaatccttttgcttttctgattggtcgcacatggcatcgggggtgggggacgtgggcgtgtctcgccagaattcgtttaactgtgatttgaagatgaacatggtattgccagagcttcatggcgtcgcctacggcgctccctccctcccaggcccttactcttctttgcattggccagatatgtcgtcactcacaaaacttcgagctcattggtgcaaaagctccaggaggcggtgggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgcaatgaatcctccaatgtacctgactctcccttcgcgaagagcatcccctccatggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaatggtgagcctttttcctttttttttttttttttgagatgaagtctcactctgttgcccaggctggagtgcagtgcagtggtgtgatcttggctcactgcaaactccacctcctggagtcaagtgattctcctgcctcagccttcagagtagctgggatcatagatgcccgtccccatgcctggttaatttttgtatttttagtagagacagggtttcaccatgttggccaggctggtctcgaacttctgagctcaagtgatccacccaccttggcctcccaaagtgctgagattacagcatgagacaccatgcccagctgtgagcctgtatcttaatcaaagtcctgagaataaccttgaagaagactcccttgcaatgagcaacaacagaagaagcaagggacctggaatctggcagacctgggttngaattctggctctgtcactttctggtgaagtgacttgagtaatgaacatgagcctttctgggtagcgtttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctnttcaagttagaaagtaagatacaatgcacacaaagccaaattgtcatcattcagctcctattacaggggaactaagagctgcattgaaaattatttgcaaagcttgtaagtggttctgccacttattagccntgtgaaccttagcaaattacctagcntctctgagtttcaacttcctcatctacaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggaagaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaaacttttgtgcatctaccgctatgtaaaggaagctgatgtcagtagactggggggaacagtaaggcatgtttgtgaccgaagctcaatttgccatcacagtgtggccacacctacctcactaatattctaatagtgggataaataattcaatagggataaagcctggattttcctcttattctctcttagtgcttacattcttggcatgatatcgatgtgccatagacaagccaatatgtgagtgtactctatctgaataaagtatagcctttctacattgcaaagtcatccagtttctaaaattattgttagaaccaatgaagtgactaagagaattttaaaaaataagccatcagtctggacctgtgtataggaatgaaggagaagcactttaaagtcagggaaaaaatataaacatacttaacatttaggattatcaaccattgctgcttttccataaaccatttcattcatgatttcatctgtaagagatatgattattgcccccattcagtgagggactttgatagttagccgcctggtccttcttgcttggatgccctgcaaataaatgtcctcctttccccantgcaaaacctcgatatggttgtttgactttactgcgcttgggccagcagaatccagttaagtccactaataagctcttggcctgtctttgagatggatttcagattcaaaatagacngaccctatcaccctgctaacttggccagtcagtatttgtcaataacatagaggcttcattcaagagatttactgggttgtaactattggaacccagggatgatttcaggattttgtggggcctgagccttatctagtaaaaacattaaaaaaattatgantacaaaaatttccaggggccctcccangaccttggaagggcctgtgcaagtgagaagcctggaaggttaggctctattcatcatcgatcaaccacagctggggcctctttttttgtttgttttttataaacttgtgtaatgcagggaaatatattgtttcaacttacaaacaccacaaaatggtgtcatattggtcataaaattactggcaccttcccttggcatcttgcctttggaaggaaatgcagtgggcctatatgtcacatatgccaaatatgactgcagtgtagctt

SEQ ID NO: 348429 - DNA, 3360 bp, Homo sapiens
  misc_feature (1243)..(1243): n is a, c, g, or t
  misc_feature (1523)..(1523): n is a, c, g, or t
  misc_feature (1655)..(1655): n is a, c, g, or t
  misc_feature (1681)..(1681): n is a, c, g, or t
  misc_feature (2790)..(2790): n is a, c, g, or t
  misc_feature (2907)..(2907): n is a, c, g, or t
  misc_feature (3067)..(3067): n is a, c, g, or t
  misc_feature (3094)..(3094): n is a, c, g, or t
gcctgcagaccgctcagctttcattccagtgaaaacattccagaaaaaactctgaatcaatcccaggtgtttctccaatcagctcaggatgattgtgtgttacctgctgcccagccagtgacacctctccaggcctctgacttagctaggtctccaccatgtgactccaccatagactccccaccttcttcttttgcaaagcctcagacacccaaacacctaccaaaagtgggtagggcaccaggacactccaagtgtaagtggggctctccagcacacctggatgtggaggtgtgatgcagagtggtggctgctcgtgacactcatttcacccctttctgtgcaggtgtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgcaatgaatcctccaatgtacctgactctcccttcgcgaagagcatcccctccatggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaatggtgagcctttttcctttttttttttttttttgagatgaagtctcactctgttgcccaggctggagtgcagtgcagtggtgtgatcttggctcactgcaaactccacctcctggagtcaagtgattctcctgcctcagccttcagagtagctgggatcatagatgcccgtccccatgcctggttaatttttgtatttttagtagagacagggtttcaccatgttggccaggctggtctcgaacttctgagctcaagtgatccacccaccttggcctcccaaagtgctgagattacagcatgagacaccatgcccagctgtgagcctgtatcttaatcaaagtcctgagaataaccttgaagaagactcccttgcaatgagcaacaacagaagaagcaagggacctggaatctggcagacctgggttngaattctggctctgtcactttctggtgaagtgacttgagtaatgaacatgagcctttctgggtagcgtttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctnttcaagttagaaagtaagatacaatgcacacaaagccaaattgtcatcattcagctcctattacaggggaactaagagctgcattgaaaattatttgcaaagcttgtaagtggttctgccacttattagccntgtgaaccttagcaaattacctagcntctctgagtttcaacttcctcatctacaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggaagaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaaacttttgtgcatctaccgctatgtaaaggaagctgatgtcagtagactggggggaacagtaaggcatgtttgtgaccgaagctcaatttgccatcacagtgtggccacacctacctcactaatattctaatagtgggataaataattcaatagggataaagcctggattttcctcttattctctcttagtgcttacattcttggcatgatatcgatgtgccatagacaagccaatatgtgagtgtactctatctgaataaagtatagcctttctacattgcaaagtcatccagtttctaaaattattgttagaaccaatgaagtgactaagagaattttaaaaaataagccatcagtctggacctgtgtataggaatgaaggagaagcactttaaagtcagggaaaaaatataaacatacttaacatttaggattatcaaccattgctgcttttccataaaccatttcattcatgatttcatctgtaagagatatgattattgcccccattcagtgagggactttgatagttagccgcctggtccttcttgcttggatgccctgcaaataaatgtcctcctttccccantgcaaaacctcgatatggttgtttgactttactgcgcttgggccagcagaatccagttaagtccactaataagctcttggcctgtctttgagatggatttcagattcaaaatagacngaccctatcaccctgctaacttggccagtcagtatttgtcaataacatagaggcttcattcaagagatttactgggttgtaactattggaacccagggatgatttcaggattttgtggggcctgagccttatctagtaaaaacattaaaaaaattatgantacaaaaatttccaggggccctcccangaccttggaagggcctgtgcaagtgagaagcctggaaggttaggctctattcatcatcgatcaaccacagctggggcctctttttttgtttgttttttataaacttgtgtaatgcagggaaatatattgtttcaacttacaaacaccacaaaatggtgtcatattggtcataaaattactggcaccttcccttggcatcttgcctttggaaggaaatgcagtgggcctatatgtcacatatgccaaatatgactgcagtgtagctt

SEQ ID NO: 348430 - DNA, 2081 bp, Homo sapiens
ggcactattaacttggcccggcccacatgtcccctcccggttggtgtgaacgctccgaggttagctcaaacctcggcgattttcccagctgattggccgtgcaaatagacaatccttttgcttttctgattggtcgcacatggcatcgggggtgggggacgtgggcgtgtctcgccagaattcgtttaactgtgatttgaagatgaacatggtattgccagagcttcatggcgtcgcctacggcgctccctccctcccaggcccttactcttctttgcattggccagatatgtcgtcactcacaaaacttcgagctcattggtgcaaaagctccaggaggcggtgggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggtaaagtagcctgaaagccagtggtgcaaccccatccccacaaccttcaccacctctagcacctccagtgataagcactaattgcctatatacaacccttttttgtttgaaatatctagagtaatttctgttttcctatctggggtagtgtaacataagaagaaatatatatttggtctctgcccccagttcctaacacaaagctcctaaaacccttggaaattcctgaatgatggcggtgctaagagcattgtcctttgttaatttatcatttttcttttctcctaggtgttttttcctttttaaacttttcttttaggttagggggtacatatgcacgttcgttatatagctaaacttgtgtcatgggggtttgttgtacagattatttcatcacccaggtaccaagcctagtacccaatagttttttctgctcctctccctcctcccaccctccaccctcaggtagggcccagtgtctgttgtttatgagttctcatcattttgctcccacttaaaagaacatacagtatttggttttctgttcctgtcttagtttgctgaggataatggcctctagctccatctgtgttcctgcaaaagacatgatctcgctgttttttatggttgcacatcttttgttctaacatttggtccttaaacctggttcctgacacagagctcctaaatcccttggaattttctgggtgatagaagcgtcctttgttctcatgaggtgactcttggtgggctccttatttggggactggtcaccaaaaagacctatggttggaagcgttgtgctgtcagccccattccccatcctctggcgtggggagtagagctggagctcaatcatgcctacgtgataaagcctccagaaaactccttaaaagacaggacttggagagcttccgggttggcgaacacatccatgttccaggagagtggtgcaccccaactccacaaggacccttccaaacctcaccctgtgtatctcttcaactggcttcatcatttgtgtcctttaaaatatcctttgtaataaatcagcactagtaagaaaactgttt

SEQ ID NO: 348431 - DNA, 1587 bp, Homo sapiens
gcctgcagaccgctcagctttcattccagtgaaaacattccagaaaaaactctgaatcaatcccaggtgtttctccaatcagctcaggatgattgtgtgttacctgctgcccagccagtgacacctctccaggcctctgacttagctaggtctccaccatgtgactccaccatagactccccaccttcttcttttgcaaagcctcagacacccaaacacctaccaaaagtgggtagggcaccaggacactccaagtgtaagtggggctctccagcacacctggatgtggaggtgtgatgcagagtggtggctgctcgtgacactcatttcacccctttctgtgcaggtgtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggttcgtgagccacacatctccccacaccaagctcctccatacaagacctcggactgcatcacgtaaatgctttttcaggggcaaaatctagagaatctgaaatgagctatcagcttcccagtttgcacaattcatcaagaaattatgcggggtcaccggcacaaatgatgaggcatctcctggaagcttaacttcttatccatcccatctcttggacagatgatgccagttaattactttgaatgcaagtttgaaaaccactgctttaaagaaaatggatactccccttaccaagcagaaagtaggattttggaaactgatgcaagggaagcaaaaaagatgcctcaggaggcacgattacaacaggattgatgcaaacggaagctgaagcttaaccaaagacattaatatacgcccacaaaagaaaatgctaaggaagtcaagtggtctgcatgaattctgaagaaaaatggagaaccaaagaacaaaatttgtcaatgaacttccagcacagtctaggttaagggagtgaatttcttgactgaatggcacagactctgtaccacctgattggctgttaccttaatggaggaattatattacaatgtataggtactttaattagaatgacctggcagttactgaggcaaaattttccgctcctttgtattctgtaatacaagaaggatctacatggatgttctgttctctgaactgtctggatgaaccggtcaacggcactcatcataccttagtttttaaatctgcattgtggtcataatctgttatttaattaatttctcgtatttttaataaaaactttgcctatatatttagacagaaattgccttactttgctgaaatgctgagaaatcctagacagttttcaaggctgggctcaaatgtcacctctactaccctttgctgtgcctcctggcactgtgcttctgacactttgtacggtcctccatga

SEQ ID NO: 348432 - DNA, 1553 bp, Homo sapiens
ggcactattaacttggcccggcccacatgtcccctcccggttggtgtgaacgctccgaggttagctcaaacctcggcgattttcccagctgattggccgtgcaaatagacaatccttttgcttttctgattggtcgcacatggcatcgggggtgggggacgtgggcgtgtctcgccagaattcgtttaactgtgatttgaagatgaacatggtattgccagagcttcatggcgtcgcctacggcgctccctccctcccaggcccttactcttctttgcattggccagatatgtcgtcactcacaaaacttcgagctcattggtgcaaaagctccaggaggcggtgggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagaaatgatgaggcatctcctggaagcttaacttcttatccatcccatctcttggacagatgatgccagttaattactttgaatgcaagtttgaaaaccactgctttaaagaaaatggatactccccttaccaagcagaaagtaggattttggaaactgatgcaagggaagcaaaaaagatgcctcaggaggcacgattacaacaggattgatgcaaacggaagctgaagcttaaccaaagacattaatatacgcccacaaaagaaaatgctaaggaagtcaagtggtctgcatgaattctgaagaaaaatggagaaccaaagaacaaaatttgtcaatgaacttccagcacagtctaggttaagggagtgaatttcttgactgaatggcacagactctgtaccacctgattggctgttaccttaatggaggaattatattacaatgtataggtactttaattagaatgacctggcagttactgaggcaaaattttccgctcctttgtattctgtaatacaagaaggatctacatggatgttctgttctctgaactgtctggatgaaccggtcaacggcactcatcataccttagtttttaaatctgcattgtggtcataatctgttatttaattaatttctcgtatttttaataaaaactttgcctatatatttagacagaaattgccttactttgctgaaatgctgagaaatcctagacagttttcaaggctgggctcaaatgtcacctctactaccctttgctgtgcctcctggcactgtgcttctgacactttgtacggtcctccatga

SEQ ID NO: 348433 - DNA, 1416 bp, Homo sapiens
gcctgcagaccgctcagctttcattccagtgaaaacattccagaaaaaactctgaatcaatcccaggtgtttctccaatcagctcaggatgattgtgtgttacctgctgcccagccagtgacacctctccaggcctctgacttagctaggtctccaccatgtgactccaccatagactccccaccttcttcttttgcaaagcctcagacacccaaacacctaccaaaagtgggtagggcaccaggacactccaagtgtaagtggggctctccagcacacctggatgtggaggtgtgatgcagagtggtggctgctcgtgacactcatttcacccctttctgtgcaggtgtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggttcgtgagccacacatctccccacaccaagctcctccatacaagacctcggactgcatcacgtaaatgctttttcaggggcaaaatctagagaatctgaaatgagctatcagcttcccagtttgcacaattcatcaagaaattatgcggggtcaccggcacaaatgatgaggcatctcctggaagcttaacttcttatccatcccatctcttggacagatgatgccagttaattactttgaatgctcctccaccaagccaaggccaggactcctgcaatcataggatggcaacaccacctctaaagcacagaacttcaggctttgcttcggaagtggcaccatggtctcttcattttccctttcttcaaggtcagaaaactgaagctgttaggagttttagtgttaagttccttccgaggatgttaattaggcttcaaactgttttgttctgagaaataaaaactaaactccagtcattcaagctaacagttgaggtgttctatggcttcaaaatcaagtaagatttgtaaatgaattgctaggtgcaaccattacttattatatgccacacaaacagtggagaaaattatggacaccaccatccaagtgattgagattattaattttaggtagcaggccaattcagacatgtccacttatcctcaatggcagggggcctctcacatcccctccctgtaacccagttcaatacttctgtctaaagtctagaatttcaatgttgaaaggagagcgtggttagtgagagaaaatccacaaagtttatcctgatgatcctttct

SEQ ID NO: 348434 - DNA, 1551 bp, Homo sapiens
ttcaccatgatagagggcgtcttgcattggttcacaatggcctgttgctttttagccttcagttggtttagggggaaattgctcaacctatgagacctgctcaaattcatactgttctggttttgctttggaattctttgtccagtaaattagctcttcatacaaatcccatgagtgcatggagaggaagtggggagagctgaagatgctagcattaagatgctagagaaacacgagacaattgatggagcaagatatctaaggaagtagaatattaagagtgagatagtgttgaaacactgaccttgggaagaaagaagaatgccgcttccattaagactgaaagagaggaggaagaggtggatattgtggaagtagagaggaagctcataccagacgacttggatcatctcagtcaagaaggggcaacagaagaatcttgggccaggacaaagcataggagggtgaagtggaaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagggtcttgctccattgaccaggctggagtgcagtggcgtgatcttggctcactgcaacgtcctcttcccaagctcagagctatcagcttcccagtttgcacaattcatcaagaaattatgcggggtcaccggcacaaatgatgaggcatctcctggaagcttaacttcttatccatcccatctcttggacagatgatgccagttaattactttgaatgctcctccaccaagccaaggccaggactcctgcaatcataggatggcaacaccacctctaaagcacagaacttcaggctttgcttcggaagtggcaccatggtctcttcattttccctttcttcaaggtcagaaaactgaagctgttaggagttttagtgttaagttccttccgaggatgttaattaggcttcaaactgttttgttctgagaaataaaaactaaactccagtcattcaagctaacagttgaggtgttctatggcttcaaaatcaagtaagatttgtaaatgaattgctaggtgcaaccattacttattatatgccacacaaacagtggagaaaattatggacaccaccatccaagtgattgagattattaattttaggtagcaggccaattcagacatgtccacttatcctcaatggcagggggcctctcacatcccctccctgtaacccagttcaatacttctgtctaaagtctagaatttcaatgttgaaaggagagcgtggttagtgagagaaaatccacaaagtttatcctgatgatcctttct

SEQ ID NO: 348435 - DNA, 404 bp, Homo sapiens
gggattacacgcctgcgccaccacacccagctaatttagtatttttagtagagatggggtttcaccatgttggtcaggctggtcacgagctcctaacctcaagtgatcccaaagtgctgtgattacaggcgtgagccatcctgcctggcctttctggttaaaattctgtgaggtttgcataaaaggaatagagtaggggcccaaaaaccagtaagatgagaaaatagtgtttcctcagttctaggatccaggggaaaaaaaaaagaaataaaagagaaaatactgtttcctgccacttaagaggaaggactcacatatcctaccttccatcagccttgaaggagacaagtgccctctctctcacacccggtggccttcccttcccctttcccagagcctccaag

SEQ ID NO: 348436 - DNA, 1193 bp, Homo sapiens
ggcactattaacttggcccggcccacatgtcccctcccggttggtgtgaacgctccgaggttagctcaaacctcggcgattttcccagctgattggccgtgcaaatagacaatccttttgcttttctgattggtcgcacatggcatcgggggtgggggacgtgggcgtgtctcgccagaattcgtttaactgtgatttgaagatgaacatggtattgccagagcttcatggcgtcgcctacggcgctccctccctcccaggcccttactcttctttgcattggccagatatgtcgtcactcacaaaacttcgagctcattggtgcaaaagctccaggaggcggtgggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaagagctatcagcttcccagtttgcacaattcatcaagaaattatgcggggtcaccggcacaaatgatgaggcatctcctggaagcttaacttcttatccatcccatctcttggacagatgatgccagttaattactttgaataaatatgggcaaaagcttatcattatcaacaaatgagaagaaagaaaccctatgccaggtaacaccaaagctttggcccagtgccctctgttgaaacatcctaggctttttctttccactcctattacaactgatctgatttggccccttcacacctcactcctagattttgctagacctttctattttgtctccctgaattaagcttttccttttggacactttacatatggattctaaaacaatcctctgcatgtctacacttgcacataatgcaaaaaacaaaataaaataatcttcctgttttgatc

SEQ ID NO: 348437 - DNA, 919 bp, Homo sapiens
ggcactattaacttggcccggcccacatgtcccctcccggttggtgtgaacgctccgaggttagctcaaacctcggcgattttcccagctgattggccgtgcaaatagacaatccttttgcttttctgattggtcgcacatggcatcgggggtgggggacgtgggcgtgtctcgccagaattcgtttaactgtgatttgaagatgaacatggtattgccagagcttcatggcgtcgcctacggcgctccctccctcccaggcccttactcttctttgcattggccagatatgtcgtcactcacaaaacttcgagctcattggtgcaaaagctccaggaggcggtgggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtaaagattattcggtttgtagcctcgatactgtttctgtgaaatgtctctaaagacggatgcttgaagtgataccttctggtgctctgctctatttacactgtcagccatttcctctcttagggtctctttatacttactggggaggtttcttttgtgagacagagtcttgccctg

SEQ ID NO: 348438 - DNA, 3789 bp, Homo sapiens
  misc_feature (1672)..(1672): n is a, c, g, or t
  misc_feature (1952)..(1952): n is a, c, g, or t
  misc_feature (2084)..(2084): n is a, c, g, or t
  misc_feature (2110)..(2110): n is a, c, g, or t
  misc_feature (3219)..(3219): n is a, c, g, or t
  misc_feature (3336)..(3336): n is a, c, g, or t
  misc_feature (3496)..(3496): n is a, c, g, or t
  misc_feature (3523)..(3523): n is a, c, g, or t
ttcaccatgatagagggcgtcttgcattggttcacaatggcctgttgctttttagccttcagttggtttagggggaaattgctcaacctatgagacctgctcaaattcatactgttctggttttgctttggaattctttgtccagtaaattagctcttcatacaaatcccatgagtgcatggagaggaagtggggagagctgaagatgctagcattaagatgctagagaaacacgagacaattgatggagcaagatatctaaggaagtagaatattaagagtgagatagtgttgaaacactgaccttgggaagaaagaagaatgccgcttccattaagactgaaagagaggaggaagaggtggatattgtggaagtagagaggaagctcataccagacgacttggatcatctcagtcaagaaggggcaacagaagaatcttgggccaggacaaagcataggagggtgaagtggaaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtgcaatgaatcctccaatgtacctgactctcccttcgcgaagagcatcccctccatggcagaaatctgaaaatgcccctggggagacacatgcacaagacagttcgtgagccacacatctccccacaccaagctcctccatacaagacctcggactgcatcacgtaaatgctttttcaggggcaaaatctagagaatctgaaatggtgagcctttttcctttttttttttttttttgagatgaagtctcactctgttgcccaggctggagtgcagtgcagtggtgtgatcttggctcactgcaaactccacctcctggagtcaagtgattctcctgcctcagccttcagagtagctgggatcatagatgcccgtccccatgcctggttaatttttgtatttttagtagagacagggtttcaccatgttggccaggctggtctcgaacttctgagctcaagtgatccacccaccttggcctcccaaagtgctgagattacagcatgagacaccatgcccagctgtgagcctgtatcttaatcaaagtcctgagaataaccttgaagaagactcccttgcaatgagcaacaacagaagaagcaagggacctggaatctggcagacctgggttngaattctggctctgtcactttctggtgaagtgacttgagtaatgaacatgagcctttctgggtagcgtttacagcacaaagcaatttgaggaataaatgaaagagcacgtgtctagtgcctagcaatgcgctggacacagtgccggtgctcagccatcatgtcacaccagcactgaccggtgagcataaaccctggggatgcccagagctggtacagccaggagctccagaagcgtgggattctcagagggaagtggagctcactgctctacaggtcctnttcaagttagaaagtaagatacaatgcacacaaagccaaattgtcatcattcagctcctattacaggggaactaagagctgcattgaaaattatttgcaaagcttgtaagtggttctgccacttattagccntgtgaaccttagcaaattacctagcntctctgagtttcaacttcctcatctacaaaatagaaatgataataataaccgcatcgcaagagttgttggaaaaatgaaaatgaggtatcataggaggtaacatgtatggagcatttaccataggccaagcactgttctaagaacttcggacatgttatctcacttgtataagtacttaggtgcctacaacataaacagcacctggtaaattaagtattgaaaaaatgctatggggcagaggaagaaatgctaagcttctgtgagaagagaagacagcttgttacacaggtgaaaagaacaagctgcagctgagagaagaaaagtataagagttgctaggtgtgacaatctcaagacttttcaaccactacaaatttaaacagccaccctaaatcaccccaaaggacagactcgagttgttctttttgtctttaatgtttgcgcctctccgaatcagagaagaagctgccaggattccagtacataccaaaacatgatgacaataccctcaactgtgcaaacttttgtgcatctaccgctatgtaaaggaagctgatgtcagtagactggggggaacagtaaggcatgtttgtgaccgaagctcaatttgccatcacagtgtggccacacctacctcactaatattctaatagtgggataaataattcaatagggataaagcctggattttcctcttattctctcttagtgcttacattcttggcatgatatcgatgtgccatagacaagccaatatgtgagtgtactctatctgaataaagtatagcctttctacattgcaaagtcatccagtttctaaaattattgttagaaccaatgaagtgactaagagaattttaaaaaataagccatcagtctggacctgtgtataggaatgaaggagaagcactttaaagtcagggaaaaaatataaacatacttaacatttaggattatcaaccattgctgcttttccataaaccatttcattcatgatttcatctgtaagagatatgattattgcccccattcagtgagggactttgatagttagccgcctggtccttcttgcttggatgccctgcaaataaatgtcctcctttccccantgcaaaacctcgatatggttgtttgactttactgcgcttgggccagcagaatccagttaagtccactaataagctcttggcctgtctttgagatggatttcagattcaaaatagacngaccctatcaccctgctaacttggccagtcagtatttgtcaataacatagaggcttcattcaagagatttactgggttgtaactattggaacccagggatgatttcaggattttgtggggcctgagccttatctagtaaaaacattaaaaaaattatgantacaaaaatttccaggggccctcccangaccttggaagggcctgtgcaagtgagaagcctggaaggttaggctctattcatcatcgatcaaccacagctggggcctctttttttgtttgttttttataaacttgtgtaatgcagggaaatatattgtttcaacttacaaacaccacaaaatggtgtcatattggtcataaaattactggcaccttcccttggcatcttgcctttggaaggaaatgcagtgggcctatatgtcacatatgccaaatatgactgcagtgtagctt

SEQ ID NO: 348439 - DNA, 1913 bp, Homo sapiens
ggcactattaacttggcccggcccacatgtcccctcccggttggtgtgaacgctccgaggttagctcaaacctcggcgattttcccagctgattggccgtgcaaatagacaatccttttgcttttctgattggtcgcacatggcatcgggggtgggggacgtgggcgtgtctcgccagaattcgtttaactgtgatttgaagatgaacatggtattgccagagcttcatggcgtcgcctacggcgctccctccctcccaggcccttactcttctttgcattggccagatatgtcgtcactcacaaaacttcgagctcattggtgcaaaagctccaggaggcggtgggtgattggttggttgctgttcctgcccccacgcctgtcgtggtttagctgaactgagctgaaatcctaaaggccgcggagtcggcggtgttgtaggtagcggtaccttgagtggcaacagaattcgattaaattacaatgggaaacatttttgaaaagctctttaaaagtctacttgggaaaaaaaagatgcggattcttatattgagtttggatacagctggaaaaaccaccatcttgtataaattgaagctgggggagactgtgcctgccgtccctacagtaggtttctgtgtggagacagtagaatataaaaataacaccttcgctgtctgggatgttggcagccacttcaaaatcagacctctgtggcagcattttttccagaacacaaaaggtgccagaagcccaggaagcacacatcaaggctcacttgccagcggggtgctgccaataaaatgtagtcacgtggaatttggaatgtggaaaggaggtagaagtcatcctttcctcccccatagcagcaggtgtgcaggctctggtggtcagctggactccatactcccccaccagtcaccagcctggggaccgtggggctgcaaggacctcagcagcggtttcccaagtttcctgacttcttccatcctctggaaatcagctgtggtaaagtagcctgaaagccagtggtgcaaccccatccccacaaccttcaccacctctagcacctccagtgataagcactaattgcctatatacaacccttttttgtttgaaatatctagagtaatttctgttttcctatctggggtagtgtaacataagaagaaatatatatttggtctctgcccccaaaaaaaaaaaaaaaaaaaaaaaaaaaaaaaaaaaaaaaaaaaaaaaaacaaaaaaaaaaaaaaaaaaaaaaaaaaaaaaaaaaaaaaaacaaaaccaaaaaaaaaaaaaaacaacaaaaaaaaagaacaacaacgagggacgggacgctgcgcggcagtcaggcacggcccgcaggacggcaggccacatacggagagcagcagacgcaggaggccctgtaaaggcgaaagacaagcagggggacacacagacgaggatgtcgtggatggacactgagcacaaaggcgcgaggtgcggcgagcacgcgagaaaaacggaaaaaaaacgcgcaacaagcgtaacaggagagaggataggagaagacgggaggagcgaagaaggaaccagctagtcgacgaccgccaggatcacagaaaggcagacggacagcggagacaccgatgagcaagagagacggaaaacgagtaatccaggggcacacacgagagcacgcgcgaacagggcgagagagacaaaaccgcaacagacaggcgagcgacgtagcctataggctaaaataacgaccagaagaccatgggggagactatgatgggacaactgagacaagcacagaaacaaagcgaagagacagaccaaaacagacacagcgtagcccacgaggcgaatgaggaaacacaataccacgggcggcgatggggtaggaacaaataggaaga

SEQ ID NO: 348440 - DNA, 2985 bp, Homo sapiens
atggcgaccgcgctgctggcgggagagaagctgcgggagctgatcctgccgggcgcgcaggacgacaaggcgggcgcgctggccgcgctgcttctgcagctgaagctggagctgccgttcgaccgggtggtcaccatcggcaccgtgctggtgcccatcctgctggtcaccctggtcttcaccaagaacttcgcagggtggacgctcttctctggctcctgggattggctgtgaggacaaaacataaaggaacccatttactgttacaccccgcacaacttcacgcgcgaccaggcgctgtacgcccgcggctactgctggacggagctgcgggacgcgctgcccggcgtggacgccagcctgtggccgtcgctgtttgagcacaagttcctgccctacgcgctgctggccttcgccgccatcatgtacgtgcccgcgctgggctgggagttcctggcctccacgcgcctcacctccgagctcaacttcctgctgcaggagatcgacaactgttaccaccgggcggccgagggccgcgcgcccaagatcgagaagcagatccagtccaagggcccgggcatcacggagcgcgagaagcgcgagatcatcgagaacgcggagaaggagaagagcccggagcagaacctgttcgagaagtacctggagcgccgcggccgcagcaacttcctggccaagctgtacctggcgcggcacgtgctgatcctgctgctgagcgccgtgcccatctcctacctgtgcacctactacgccacgcagaagcagaacgagttcacctgcgcgctgggcgcgtccccggacggggcggcaggtgcggggcccgcggtgcgcgtgagctgcaagctcccgtccgtgcaactgcagcgcatcatcgcgggcgtggacatcgtgctgctgtgcgtcatgaacctcatcatcctcgtcaacctcatccacctcttcatcttccgcaagagcaacttcatcttcgacaagctgcacaaggtgggcatcaagacgcgccggcagtggcgccgctcgcagttctgcgacatcaacatcctggccatgttctgcaacgagaaccgcgaccacatcaagtcgctcaaccggctggacttcatcaccaacgagagcgacctcatgtacgacaacgtggtccggcagctgctggcggcgctggcgcagtccaaccacgacgccacccccacggtgcgcgactcgggggtgcagaccgtggaccccagcgccaaccccgccgagcccgacggcgccgccgagccgcccgtggtcaagcggccgcgcaagaagatgaagtggatccccaccagcaacccgcttccgcagcccttcaaggagccgctggccatcatgcgcgtggagaacagcaaggcggagaagccgaagcccgcgcgcaggaagacggccacggacacgctgatcgcgccgctgctggaccgctccgcccaccactacaagggcggagggggcgacccgggccccggccccgcccctgcccccgccccgccgcccgcccctgacaagaagcacgcgcgccacttctccctggacgtgcacccctacatcctcggcaccaagaaggccaaggccgaggcggtgcccgccgccctgcccgcctcccggagccaggaggggggcttcctgtcccaggcggaggactgtgggctaggcctggccccggcgcccatcaaagatgctccgctccccgagaaggaaatcccgtaccccacagagccagcccgggcagggcttccctcggggggcccgttccacgtccgctcacctcccgccgcccctgctgtggcccctctgacaccagccagcctgggcaaggcggagcccctcaccatcctgagccgaaacgccacacacccgctgctgcacatcaacacgctatcctcatcgccaccttcgacgagccgagaacggtcgtgagtactgtggagttttgagggatggcaccgtccaggccgccgagagcccctctgcctgtgtcgtgtggcctggccagcctcccggtggacaccagccctgcgtggacgtggcctgtgcttcgcccgcactgcgcgcatccccaacctctgtccgcatgcctggggccttcgcccccacgtgctcgacaggggaacccgcccggacggcatcgccaggcactggctggggtggggaaaggtggcccagtggagccggtggccaggaaggctgaagcccgcttcccatgctcctgcatcaggtgcccagccgtgggtgggggccctgaggtgaagagtttatttttttagtccgtttcatcctggccccgggctgtggcgagacagcccaactcccccagcccagctcccccagcccagagccagggaagaggaaggtggggccagtcccaccagtggggtggccacgcccatggggtcacatgctcaggggtcaccccctgcagggacctgatgccctcgggtgggagggaccgaggtccaccctcgggtcaaaggtcaacgtgcactttctccttgtcgcctgacagacattttattttactaagactgctgtaccgaacaagcatatttatcatcaggagacaggatgggtttaaagcaggatggtgtgtgtgtgaacgggcatgagcagaggtgagcgtgagcgagcgggtgtgtatgtacgagtgtgcacgtgtgtgcgtgtgcacagagggtgtggtgccagcttgagtgggagtgtgtgagtgtgagcaggcgggcgagtgcgtgagtgcacgccagcgcgtggcccatgtatgaggagtgaaggggcccaacgcaataaccacgtcccccacccgggccccccgccgcggctgaggccacatggcttcctgtgggagccccggccggcacccggctggtcccaccccaaatacctcagccatggagaccatgtcatgcagaattaacaaggtagcaccgagcatatcaataaatattattctgataa

SEQ ID NO: 348441 - DNA, 321 bp, Homo sapiens
atggcgaccgcgctgctggcgggagagaagctgcgggagctgatcctgccgggcgcgcaggacgacaaggcgggcgcgctggccgcgctgcttctgcagctgaagctggagctgccgttcgaccgggtggtcaccatcggcaccgtgctggtgcccatcctgctggtcaccctggtcttcaccaagaacttcgcagggtggacgctcttctctggctcctgggattggctgtgaggacaaaacataagtaaataaaatatgccattttcttcactaaaaaaagaaataaaaaaaggaggtacaaaaaagtcgtatcgatgt

SEQ ID NO: 348442 - DNA, 454 bp, Homo sapiens
ggtggagcagatgaggaaactgaggtcggagtggcaagcaggacttggcttccccttgctgccgccatccggcagggagacagtgacaggcatgaggagttcgggtccaagtggggctccgcacagtgggggcagctcgccagacacgtggctcggtgtggggcccctgctttcatccaccttggaggaggccaggccgccccctgccccagagccaaggagccctccttcccatctccctgcggccctactggagtctgggtccagggttctggggcctctccccacccatgttggccacacatgcccagcaagggtggctgccagggatgggcccagctcaggacgggacacaaacctgtccctgttctcttccccagggtggacgctcttctctggctcctgggattggctgtgaggacaaaacataagtaaataaaatatgccattttct

SEQ ID NO: 348443 - DNA, 498 bp, Homo sapiens
cagcccggtttcttcagcccagcccgtgcgcctccccgccccagcccgtgtctcctctttgcccccagaggaacccatttactgttacaccccgcacaacttcacgcgcgaccaggcgctgtacgcccgcggctactgctggacggagctgcgggacgcgctgcccggcgtggacgccagcctgtggccgtcgctgtttgagcacaagttcctgccctacgcgctgctggccttcgccgccatcatgtacgtgcccgcgctgggctgggagttcctggcctccacgcgcctcacctccgagctcaacttcctgctgcaggagatcgacaactgttaccaccgggcggccgagggccgcgcgcccaagatcgagaagcagatccagtccaagggcccgggcatcacggagcgcgagaagcgcgagatcatcgagaacgcggagaaggagaagagcccggagcagaacctgttcgagaagtacctggagcgccgcggccg

SEQ ID NO: 348444 - DNA, 2934 bp, Homo sapiens
atggcgaccgcgctgctggcgggagagaagctgcgggagctgatcctgccgggcgcgcaggacgacaaggcgggcgcgctggccgcgctgcttctgcagctgaagctggagctgccgttcgaccgggtggtcaccatcggcaccgtgctggtgcccatcctgctggtcaccctggtcttcaccaagaacttcgcagaggaacccatttactgttacaccccgcacaacttcacgcgcgaccaggcgctgtacgcccgcggctactgctggacggagctgcgggacgcgctgcccggcgtggacgccagcctgtggccgtcgctgtttgagcacaagttcctgccctacgcgctgctggccttcgccgccatcatgtacgtgcccgcgctgggctgggagttcctggcctccacgcgcctcacctccgagctcaacttcctgctgcaggagatcgacaactgttaccaccgggcggccgagggccgcgcgcccaagatcgagaagcagatccagtccaagggcccgggcatcacggagcgcgagaagcgcgagatcatcgagaacgcggagaaggagaagagcccggagcagaacctgttcgagaagtacctggagcgccgcggccgcagcaacttcctggccaagctgtacctggcgcggcacgtgctgatcctgctgctgagcgccgtgcccatctcctacctgtgcacctactacgccacgcagaagcagaacgagttcacctgcgcgctgggcgcgtccccggacggggcggcaggtgcggggcccgcggtgcgcgtgagctgcaagctcccgtccgtgcaactgcagcgcatcatcgcgggcgtggacatcgtgctgctgtgcgtcatgaacctcatcatcctcgtcaacctcatccacctcttcatcttccgcaagagcaacttcatcttcgacaagctgcacaaggtgggcatcaagacgcgccggcagtggcgccgctcgcagttctgcgacatcaacatcctggccatgttctgcaacgagaaccgcgaccacatcaagtcgctcaaccggctggacttcatcaccaacgagagcgacctcatgtacgacaacgtggtccggcagctgctggcggcgctggcgcagtccaaccacgacgccacccccacggtgcgcgactcgggggtgcagaccgtggaccccagcgccaaccccgccgagcccgacggcgccgccgagccgcccgtggtcaagcggccgcgcaagaagatgaagtggatccccaccagcaacccgcttccgcagcccttcaaggagccgctggccatcatgcgcgtggagaacagcaaggcggagaagccgaagcccgcgcgcaggaagacggccacggacacgctgatcgcgccgctgctggaccgctccgcccaccactacaagggcggagggggcgacccgggccccggccccgcccctgcccccgccccgccgcccgcccctgacaagaagcacgcgcgccacttctccctggacgtgcacccctacatcctcggcaccaagaaggccaaggccgaggcggtgcccgccgccctgcccgcctcccggagccaggaggggggcttcctgtcccaggcggaggactgtgggctaggcctggccccggcgcccatcaaagatgctccgctccccgagaaggaaatcccgtaccccacagagccagcccgggcagggcttccctcggggggcccgttccacgtccgctcacctcccgccgcccctgctgtggcccctctgacaccagccagcctgggcaaggcggagcccctcaccatcctgagccgaaacgccacacacccgctgctgcacatcaacacgctatcctcatcgccaccttcgacgagccgagaacggtcgtgagtactgtggagttttgagggatggcaccgtccaggccgccgagagcccctctgcctgtgtcgtgtggcctggccagcctcccggtggacaccagccctgcgtggacgtggcctgtgcttcgcccgcactgcgcgcatccccaacctctgtccgcatgcctggggccttcgcccccacgtgctcgacaggggaacccgcccggacggcatcgccaggcactggctggggtggggaaaggtggcccagtggagccggtggccaggaaggctgaagcccgcttcccatgctcctgcatcaggtgcccagccgtgggtgggggccctgaggtgaagagtttatttttttagtccgtttcatcctggccccgggctgtggcgagacagcccaactcccccagcccagctcccccagcccagagccagggaagaggaaggtggggccagtcccaccagtggggtggccacgcccatggggtcacatgctcaggggtcaccccctgcagggacctgatgccctcgggtgggagggaccgaggtccaccctcgggtcaaaggtcaacgtgcactttctccttgtcgcctgacagacattttattttactaagactgctgtaccgaacaagcatatttatcatcaggagacaggatgggtttaaagcaggatggtgtgtgtgtgaacgggcatgagcagaggtgagcgtgagcgagcgggtgtgtatgtacgagtgtgcacgtgtgtgcgtgtgcacagagggtgtggtgccagcttgagtgggagtgtgtgagtgtgagcaggcgggcgagtgcgtgagtgcacgccagcgcgtggcccatgtatgaggagtgaaggggcccaacgcaataaccacgtcccccacccgggccccccgccgcggctgaggccacatggcttcctgtgggagccccggccggcacccggctggtcccaccccaaatacctcagccatggagaccatgtcatgcagaattaacaaggtagcaccgagcatatcaataaatattattctgataa

SEQ ID NO: 348445 - DNA, 2038 bp, Homo sapiens
atggcgaccgcgctgctggcgggagagaagctgcgggagctgatcctgccgggcgcgcaggacgacaaggcgggcgcgctggccgcgctgcttctgcagctgaagctggagctgccgttcgaccgggtggtcaccatcggcaccgtgctggtgcccatcctgctggtcaccctggtcttcaccaagaacttcgcagaggaacccatttactgttacaccccgcacaacttcacgcgcgaccaggcgctgtacgcccgcggctactgctggacggagctgcgggacgcgctgcccggcgtggacgccagcctgtggccgtcgctgtttgagcacaagttcctgccctacgcgctgctggccttcgccgccatcatgtacgtgcccgcgctgggctgggagttcctggcctccacgcgcctcacctccgagctcaacttcctgctgcaggagatcgacaactgttaccaccgggcggccgagggccgcgcgcccaagatcgagaagcagatccagtccaagggcccgggcatcacggagcgcgagaagcgcgagatcatcgagaacgcggagaaggagaagagcccggagcagaacctgttcgagaagtacctggagcgccgcggccgcagcaacttcctggccaagctgtacctggcgcggcacgtgctgatcctgctgctgagcgccgtgcccatctcctacctgtgcacctactacgccacgcagaagcagaacgagttcacctgcgcgctgggcgcgtccccggacggggcggcaggtgcggggcccgcggtgcgcgtgagctgcaagctcccgtccgtgcaactgcagcgcatcatcgcgggcgtggacatcgtgctgctgtgcgtcatgaacctcatcatcctcgtcaacctcatccacctcttcatcttccgcaagagcaacttcatcttcgacaagctgcacaaggtgggcatcaagacgcgccggcagtggcgccgctcgcagttctgcgacatcaacatcctggccatgttctgcaacgagaaccgcgaccacatcaagtcgctcaaccggctggacttcatcaccaacgagagcgacctcatgtacgacaacgtggtccggcagctgctggcggcgctggcgcagtccaaccacgacgccacccccacggtgcgcgactcgggggtgcagaccgtggaccccagcgccaaccccgccgagcccgacggcgccgccgagccgcccgtggtcaagcggccgcgcaagaagatgaagtggatccccaccagcaacccgttcccatgctcctgcatcaggtgcccagccgtgggtgggggccctgaggtgaagagtttatttttttagtccgtttcatcctggccccgggctgtggcgagacagcccaactcccccagcccagctcccccagcccagagccagggaagaggaaggtggggccagtcccaccagtggggtggccacgcccatggggtcacatgctcaggggtcaccccctgcagggacctgatgccctcgggtgggagggaccgaggtccaccctcgggtcaaaggtcaacgtgcactttctccttgtcgcctgacagacattttattttactaagactgctgtaccgaacaagcatatttatcatcaggagacaggatgggtttaaagcaggatggtgtgtgtgtgaacgggcatgagcagaggtgagcgtgagcgagcgggtgtgtatgtacgagtgtgcacgtgtgtgcgtgtgcacagagggtgtggtgccagcttgagtgggagtgtgtgagtgtgagcaggcgggcgagtgcgtgagtgcacgccagcgcgtggcccatgtatgaggagtgaaggggcccaacgcaataaccacgtcccccacccgggccccccgccgcggctgaggccacatggcttcctgtgggagccccggccggcacccggctggtcccaccccaaatacctcagccatggagaccatgtcatgcagaattaacaaggtagcaccgagcatatcaataaatattattctgataa

SEQ ID NO: 348446 - DNA, 488 bp, Homo sapiens
cctcctgagttcaagccattctcctgcctcagcctccctagtagctgggattagaggcacaagccaccatgcccctacttaatcaaggagaatatgggcttggagaggtctcatttccaggctaatgtcatagccaataaatggtggggttgcgttttggggccaccaccgcctgaccccaaggatccagcaataccgagcacagctgcctccctgatgactaaccctcaactctccccagctctgtgctccacttgtactcagctgtgtgcagttccctgaacaaccattccccaacgcccccacaccttggcccatattctcccctggccttggagggcctcccctttcttggtctggctgacacccacccatcttccaggactcagcccaaaatccctgctcccgaggaagcccactctgtgccacgctgtgagcacacccacatgtccctgaaatgtcctgggctccacactcccggggcactc

SEQ ID NO: 348447 - DNA, 549 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggtgagaaggtggtggagggttgggcgt

SEQ ID NO: 348448 - DNA, 1561 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttctttcttttttttttcttttctttttttttttttttttt

SEQ ID NO: 348449 - DNA, 1865 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaaaaaaaaaaaaaaaaaaaaaacactttttgggccgcctgggccctgaaaaaagtttttaaaacccttcggttggggccgcgggggcgccgcagttgggttacgcgtcacacctgtcgctcataagcggtgttccctaaggaaaagactccggcggccacaagagacatagcggcgcttgggtatttctctctcctccaatatattaaaaaaacccgccgcggcgggggacacacccgagacgcctgttcctgtgacaccaaactctcccaagatcggagcgctccacgaagaggggccaaatacgcggggatctcttttaacaacgggagctgctcccagggagacgctcgatttttaaaatttacgcg

SEQ ID NO: 348450 - DNA, 1584 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttccctgagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348451 - DNA, 1587 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348452 - DNA, 1632 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348453 - DNA, 1516 bp, Homo sapiens
  misc_feature (15)..(15): n is a, c, g, or t
  misc_feature (19)..(19): n is a, c, g, or t
  misc_feature (26)..(26): n is a, c, g, or t
  misc_feature (82)..(82): n is a, c, g, or t
ggcgtgggtaccgcncccncgcgtangatatgtcacagggccggggctctcttggtgcggactgatgtcatggtccgggggncggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348454 - DNA, 1451 bp, Homo sapiens
gtcccctgccagcccctcggcctcaccccattcccactccgtgtcctggggcccgcccagcctccttaggcgccgcgcctgctcgcggtctccgctgacaccccagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348455 - DNA, 1260 bp, Homo sapiens
gcctcctccattggggaggaggtggaggaggccttcccatcagtaaagccacctcacgaactgtgctgatgggaaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348456 - DNA, 1289 bp, Homo sapiens
aaaacatttaggctagtacgaggctggtgtgaattcggccgaggtagcttgcggcctgtgtctatggtcgggccctctgcgtccagctgctccggaccgagctcgggtgtatggggccgtaggaaccggctccggggccccgataacgggccgcccccacagcaccccgggctggcgtgaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348457 - DNA, 1302 bp, Homo sapiens
aagtggggaccctgaggaaataatgagaggccatgttgggttaaaggggattgaaaagtgagcatttactctggtcaggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348458 - DNA, 1458 bp, Homo sapiens
ctggggccccgaagttcctgatcgaccacacagtgccggcggcgctggcttgagcggtctcaccttggatcatgagaaatggttacactctcggatattagccattggataacattgttgtcggtgtctatgagagaacagtgtacattggccccagtagatcacccaacagtggccaacattagttgtgccctccacagagtgtgacgcagtccccaactggacgcgaggaagcgtgcgaaggacggctgttcccctagttagtcacaggtcttcgctgaagcgcttgcgcgtttgagtgttaggcgagctggaggcattccgagtcatccgcaagtggttgtgcgtgctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348459 - DNA, 1517 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaagcaagttgtgtttcatggtaacccatggggtccccatccattcttcctattccctttaggttgttacactctggtaccgagctcccgaagttcttctgcagtccacatatgcaacacctgtggacatgtggagtgttggctgtatctttgcagagatgtttcgtcgaaaaagtatgggacccacataccctggactaccttgaattccccaaatcgcttgttcataaaccacatccataccttgcccattctttttttttgagaccagggcttgctgtgttgcccaggctggattgcaatggcatgatcacagctcactgcagcttcaacctcctgggctcaagtgatcctcccatctcagcttcccaactagctgacactacaggcacgcacctccatgcttggctagtttgttaatatttttatagagatggggtctcagtatattgcccaggctggtcttgaactcttgcactcaagcaatcctcccacccctacctcccaaagtagcataagctactgcatctggccccattcttttacttgcgtactactaacttgcccatagcagaaagctctgaaatgttctggaa

SEQ ID NO: 348460 - DNA, 985 bp, Homo sapiens
cgatctcttgacctcatgatccacccacatcagactcccaaagtgctaggattacaggcgtgagccgctgcacctggcatttctttttttttaaaaaaagagacaaggtcttgcttgcccaggctgatctagaactcctgggctcaagcagtcctctcacctcagcatcccaaagtgctggaattgttggcctttattccctatacttcctattttgagccactaagcagtaaccattcaactaagatatctttgaaaatgactgctaccttatatcccttctcaccttaggcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348461 - DNA, 751 bp, Homo sapiens
tggtggcacacgcctgtaatctcagctacttgggaggctgagataggagaatcacttcaactcaggaggcggaggttgcagtgagctgagatcataccattgcactccagcctgggtgatagagcgagactccgtctcaaaaaaaaaaaaaaagaaaaaagaagaaagctcatcccaggtattgttgtgggtgggcagaagtctgttttcttcatggttttctgacctttgcctctcccctcaggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348462 - DNA, 540 bp, Homo sapiens
attctagggtcttagggagcaccgctgctgtaggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348463 - DNA, 1633 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggtgagtggggttggtaggcattgagaggtggattgggacctttgtagtagaaccttctgggatttcaggtatggtgcctagtttccagtgcatctgtacctcccctttgaaactaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaagcaagttgtgtttcatggtaacccatggggtccccatccattcttcctattccctttaggttgttacactctggtaccgagctcccgaagttcttctgcagtccacatatgcaacacctgtggacatgtggagtgttggctgtatctttgcagagatgtttcgtcgaaaaagtatgggacccacataccctggactaccttgaattccccaaatcgcttgttcataaaccacatccataccttgcccattctttttttttgagaccagggcttgctgtgttgcccaggctggattgcaatggcatgatcacagctcactgcagcttcaacctcctgggctcaagtgatcctcccatctcagcttcccaactagctgacactacaggcacgcacctccatgcttggctagtttgttaatatttttatagagatggggtctcagtatattgcccaggctggtcttgaactcttgcactcaagcaatcctcccacccctacctcccaaagtagcataagctactgcatctggccccattcttttacttgcgtactactaacttgcccatagcagaaagctctgaaatgttctggaa

SEQ ID NO: 348464 - DNA, 468 bp, Homo sapiens
cggcttatttttagactgcggatcatactatggcgttaggtcgtcctgtactgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348465 - DNA, 816 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccgccgtgatgagacgtctgtgcacacattaccgaactgaccggggagatcaagggtaacaccatggatgctcgtgagcaatgtagcaaccacggcaccttagagggacgatatctggcacaaggcacccccccacgcaaggactgtgcccaagcacgaacaacggaatcgacagggactcttgactggcgcccagtctatctacacgagcgcctagaattctccttcaagtggcccaatatgcactccgcttacacccgcagaactcttgacaggcccagcagaaccactccctgg

SEQ ID NO: 348466 - DNA, 679 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348467 - DNA, 1076 bp, Homo sapiens
aaaacatttaggctagtacgaggctggtgtgaattcggccgaggtagcttgcggcctgtgtctatggtcgggccctctgcgtccagctgctccggaccgagctcgggtgtatggggccgtaggaaccggctccggggccccgataacgggccgcccccacagcaccccgggctggcgtgaggtaagtgcagtcccttcccaggaatgagaaccagtgcccgcccccctcacagctttccacgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaagcgttttctattgcagggcctcacgtggctggaggggttggtattgagtcattgtgttatctctggggccggccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtgagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348468 - DNA, 699 bp, Homo sapiens
ttctattctgagtcctctttctgctgaacccaggatggcaactggctctgcccatggggatgggaactggaggaccctcctgaccagagttctcctgtcccccacagcctgattgggctgcctccagaggatgactggcctcgagatgtatccctgccccgtggagcctttccccccagagggccccgcccagtgcagtcggtggtacctgagatggaggagtcgggagcacagctgctgctgggtactggagatggctgtgggcacagggaaagaaatagagactggggaaagaaatagagcagtatgcagggccctggccactgtggttaatgaaacttggttggtagatgggctgtagtttttattacagctgcaaatagccacccacagagaaggatatagaagagaacccatcctggctgggcacggtggctcacgcctgtaatcccagcactttgggaggccaaggtgggcgtatcacctgaggtcaggagttcgagaccagcctggccaacatggtgaaacctcgtctctactaaaagtacaaaaataagccgggggtggtggcacacgcctgtaatctcagctacttgggaggctgagataggagaatcacttcaactcaggaggcggaggttgcagtgagctgagatcataccattgcactccagcctgggtgatagagcgagactccgt

SEQ ID NO: 348469 - DNA, 1630 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348470 - DNA, 1597 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaaaaaaatcgggcaattgcggcgggaaaaggttgacggcagggaagggtccgacaatttgacagggatgcggccaaggagatatcgagcgtctgttacacaa

SEQ ID NO: 348471 - DNA, 1526 bp, Homo sapiens
aaaacatttaggctagtacgaggctggtgtgaattcggccgaggtagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348472 - DNA, 1289 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttcgacttctccccttctgtcgtcttct

SEQ ID NO: 348473 - DNA, 1443 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348474 - DNA, 1789 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggtcagtagaaagatggtaccaaaatgggttctggttgggagtaggagagtgattgcccgtagcaattgagaagtcatgtgcttcatgtgttcagtcaagcaagttgtgtttcatggtaacccatggggtccccatccattcttcctattccctttaggttgttacactctggtaccgagctcccgaagttcttctgcagtccacatatgcaacacctgtggacatgtggagtgttggctgtatctttgcagagatgtttcgtcgaaaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348475 - DNA, 1964 bp, Homo sapiens
aaaacatttaggctagtacgaggctggtgtgaattcggccgaggtagcttgcggcctgtgtctatggtcgggccctctgcgtccagctgctccggaccgagctcgggtgtatggggccgtaggaaccggctccggggccccgataacgggccgcccccacagcaccccgggctggcgtgaggtaagtgcagtcccttcccaggaatgagaaccagtgcccgcccccctcacagctttccacgcgttcgtttcgcgagctggttatggaagggtcgctcaagggcgggaagtggggcctttgtggtcatgggaaagtataattttagggactgaggtgtaggatcttcgatgcaaggcatgtgtcatgtgtgatctttgtgcggggcgcgattgtcccaaaggaaaaagcgttttctattgcagggcctcacgtggctggaggggttggtattgagtcattgtgttatctctggggccggccccaaggaagactgggagcgggggatgggatgctggtggtgttctttgcgctttttttttgggagtccctttgttgctgcaggctcataccatcctaactctgtaagcgacttttggtgataggagtctgtgattgtagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348476 - DNA, 1494 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348477 - DNA, 1264 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaagaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348478 - DNA, 1253 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtccccaatggaggaggaggtggaggaggccttcccatcagcacagttcgtgaggtggctttactgaggcgactggaggcttttgagcatcccaatgttgtccggctgatggacgtctgtgccacatcccgaactgaccgggagatcaaggtaaccctggtgtttgagcatgtagaccaggacctaaggacatatctggacaaggcacccccaccaggcttgccagccgaaacgatcaaggatctgatgcgccagtttctaagaggcctagatttccttcatgccaattgcatcgttcaccgagatctgaagccagagaacattctggtgacaagtggtggaacagtcaagctggctgactttggcctggccagaatctacagctaccagatggcacttacacccgtggactactctcactgtggaaactctgacagccgaccaagtgggcaaaatctttgacctgatagggcctgcctaccagaaggattgacctgggcctcgagcatggtatcccctaggcgccagaggcgagccccttaccacccccaggaagggggccccggcgccagcgcacgtccggcaggcaccatgagatgcacgcgaccgcacgcgggacaccaacgcgcgaggcactcagggcacagcggcggaactctaacaacccgcaacagaaccaaaaaccgcgcgcacccacgaagacaccgcgaaccgacactaccccaccaaacacggcggcaaaggacacacccgcacgcgccacacggcagcgagcccgccagcgacggcccgaccacacgccaacggcccccacgccacggaacagacgaccccc

SEQ ID NO: 348479 - DNA, 979 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgaggcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348480 - DNA, 983 bp, Homo sapiens
atatattatgcaccagtttacatactgctatatggcctatcgaacgacatagggtatcctcatcgagtactcatctgccgcatccatcttggtgactggtcgtcgtatacaccgtctgtgcatgtaggtagaacccgtggcagaatctacagctaccagatggcacttacacccgtggttgttacactctggtaccgagctcccgaagttcttctgcagtccacatatgcaacacctgtggacatgtggagtgttggctgtatctttgcagagatgtttcgtcgaaaaagcctctcttctgtggaaactctgaagccgaccagttgggcaaaatctttgacctgattgggctgcctccagaggatgactggcctcgagatgtatccctgccccgtggagcctttccccccagagggccccgcccagtgcagtcggtggtacctgagatggaggagtcgggagcacagctgctgctggaaatgctgacttttaacccacacaagcgaatctctgcctttcgagctctgcagcactcttatctacataaggatgaaggtaatccggagtgagcaatggagtggctgccatggaaggaagaaaagctgccatttcccttctggacactgagagggcaatctttgcctttatctctgaggctatggagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348481 - DNA, 742 bp, Homo sapiens
tcccagtcgaagcacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagcaccccgggctggcgtgagggtctcccttgatctgagaatggctacctctcgatatgagccagtggctgaaattggtgtcggtgcctatgggacagtgtacaaggcccgtgatccccacagtggccactttgtggccctcaagagtgtgagagtgagggtcctcctccatctttctacagagattactttgctgccttaatgacattcccctcccacctctccttttgaggcttctccttctccttcccatttctctacactaaggggtatgttccctcttgtccctttccctacctttatatttggggtccttttttatacaggaaaaacaaaacaaagaaataatggtctttttttttttttttttttttttttttttttttttttttttttttttttttttttttttttttttttttttttttttttttgtgtgtgggggggagagagagaggggaggggggggggggagtga

SEQ ID NO: 348482 - DNA, 467 bp, Homo sapiens
aaataagtttaatatattaaaaaaagacaacagagtaaacaagaagcactgaggcatgagacaacatgacatgcaaaagacagtaaagttgaactagtaacataatttctaatgtctccaaatgacgaaagtagcatacagctcttaaaactgacatgagaaagtgcatttagtgacttcagtctttggtggaagttcctagtgtatgaaatggaacagatgagaaaaggccttggttcccatgctgtgggaatagggaactggtgaagggctaagtatcagaggacgtgtaattcagataaatcactccgttggttacctggagggtgaatttgaggagaatgagactggaggcaggagcaaggcagtaccagtgcaggtgaagaaagaacataggtagaacttggccaccaattagaaaaggtgagaggaggagccaaggagagggaaacatgtgggatcacggc

SEQ ID NO: 348483 - DNA, 147 bp, Homo sapiens
ccataggagaatgactgggtttctcattaattgattagaaggtacattgttaaggtaacagctgctgtaacaaatcagcccaaataaataatggttcaaagacaatagttgttcttttgtttcactcctgataaatttaaaacaatg

SEQ ID NO: 348484 - DNA, 4166 bp, Homo sapiens
gaggactgcgagcacagcggcggccgggtggcgggggtgagtggggccagcggggctggacagcagcgggccccgggcgccgccgccgcgatccctccccgcgcccgccgagcacatcgccgccgccgagatgggccctccgcggcacccccaggccggcgagatagaagcgggcggtgcgggcggcgggcggcggctacaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggaatggcagttcggaaaaccctcattcctcctcagcctcctgatgttgctagtcctcgagtggaaagctctatgcggagtacgtctgggtcacctaggcctgcaggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgta

SEQ ID NO: 348485 - DNA, 1667 bp, Homo sapiens
ctgctttaggaggtagcacttagtggaggtaaaggaggggagtaagcagcctggtgtcctcttggcttgcctctcctagatgaaaccattacctcaaataaaaaagttcttatggccaggtacggcagctcatgcctataatcccaacactttgggaggccatggcaggcaaattgcttgagcccaggagttcaagaccaacctgggcaacatagcaagacctcatctctacaaaaaatacaaaagtgagcccagcatgatggcgcacacctgtagtcccagctacttgggaggccgaagtgggagaatcatttgagcctaggaggcaggggttgcagtgacctgagattgtaccactgcacttcagcctgggtgacagagccagacactgtctcaaaaaaaaaataaaattcttgttaaaataatggcatttacactgctcgaacacaaatcatttacctttttaaacactgaaatacatgtatttttattttttatggttccagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgta

SEQ ID NO: 348486 - DNA, 3951 bp, Homo sapiens
gaggactgcgagcacagcggcggccgggtggcgggggtgagtggggccagcggggctggacagcagcgggccccgggcgccgccgccgcgatccctccccgcgcccgccgagcacatcgccgccgccgagatgggccctccgcggcacccccaggccggcgagatagaagcgggcggtgcgggcggcgggcggcggctacaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggaatggcagttcggaaaaccctcattcctcctcagcctcctgatgttgctagtcctcgagtggaaagctctatgcggagtacgtctgggtcacctaggcctgcaggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactgggtaaagtaaacacacactgtaagtaagcagggatcctctagc

SEQ ID NO: 348487 - DNA, 954 bp, Homo sapiens
ccagttacaacagctgttgtccagttacaacagctaaaaaggaatgctattctgatatgtgtgataccatggatgagccttgaaaacataccaagtgcaataagccagacacacacacacatgcacacacacacacacaaaaccaaatattgtatgattctccttacctgagggtccagaaaaagcaaattcatagagatagaaaatagaagttacaagggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgta

SEQ ID NO: 348488 - DNA, 392 bp, Homo sapiens
acagccagagtgctagcaccaacgctcccgcccagggctcatcgccacggccaagcatactccggaagaaacctgccacagatgggtgagtagacctggtagtgccgaatgacacctctggttctggatataactggtatacataataggcactcttatctaatgctggtatcaaactcatctctcattttctgtggtgtgttaaaatttcctccaaaacaacttgaccacaggattattcagtagagccttacccagctgagactgtaagatcttaacaaatcctggagtcagtgaggtgttagtttgtaagcatctgttgcatactgctttaattctctctagttctggaacttcaatcatagaacttttaaagtagtttataagtaact

SEQ ID NO: 348489 - DNA, 330 bp, Homo sapiens
ccaagatcacgccacttcactccagcatgggtaacagagtgagaccctgtctcaaaatttttttaaaattaaaaatttaaaaaaaggaaatagagtataaattgtgcagtgtgctggacagaaataattggacaaatactcatcctctgagatgttgtagatgaaggcagtttttttcttatttgctacatgtgcttttcttttgtgttttagtgccaaacccaagtctgaaatccacgtgtctatggccactccggtcactgtgtccatggagactgtatccaatcaaaataatgatcagcctaccattgccgtccctccaactgccca

SEQ ID NO: 348490 - DNA, 4061 bp, Homo sapiens
gaggactgcgagcacagcggcggccgggtggcgggggtgagtggggccagcggggctggacagcagcgggccccgggcgccgccgccgcgatccctccccgcgcccgccgagcacatcgccgccgccgagatgggccctccgcggcacccccaggccggcgagatagaagcgggcggtgcgggcggcgggcggcggctacaggtggaaatgagttctcaacagtttcctcggttaggagccccttctaccgggctgagccaggccccttctcagattgcaaacagtggttctgctggattgataaacccagctgctacagtcaatgatgaatctggtcgagattctgaagtcagtgccagggagcacatgagttccagcagctccctccagtcccgggaggagaagcaagagcctgttgtggtaaggccctatccacaggtgcagatgttgtcgacacaccatgctgtcgcatcagccacacctgttgcagtgacagccccgccagcacacctgacgccagcagtgccactttcattttcggagggacttatgaagccgcccccgaagcccaccatgcctagccgtcccattgctcctgctccaccttctaccctgtcacttccccccaaggttccagggcaggttaccgttaccatggagagtagcatccctcaagcttcagccattcctgtggcaacaatcagtggacaacagggccatcccagtaacctgcatcacatcatgactacaaatgtgcaaatgtctatcatccgcagcaatgctcctgggccccctcttcacattggagcttctcatttacctcgaggtgcagctgctgctgctgtgatgtccagttctaaagtaaccacagtcctgaggccgacctcacagctgccaaatgctgctactgctcagccagcagtacagcacatcattcaccaaccaatccagtctcggccacctgtgaccacctccaatgccatccctcctgctgtggtagcaactgtctcagccaccagagctcagtctccagtcatcactacgacagcggcgcatgctactgattcagcacttagtaggccaaccttgtctatccagcatcctccatctgcagcaatcagtattcagcgtcctgcccagtcacgagatgtcacaacaagaatcacactaccatctcaccctgcattagggacgccaaaacagcagcttcatacaatggctcagaaaacaatcttcagtactggcacgccagtggctgcagccacagtagcacctattttggcaaccaacaccattccttcagcgaccacagctggatctgtgtcacacacgcaagctcccacaagtaccattgttaccatgacagtaccctcccattcctcccatgctactgctgtgaccacctcaaacatcccagtcgccaaggtggtgccccagcagatcacgcacacttctcctcggatccagccagactaccctgccgagaggagtagcctgattcccatctccggacatcgggcctctcccaatcctgtggccatggaaacccgaagtgacaacagaccgtctgttcccgttcagttccaatattttttgccaacttaccccccttctgcatacccactggcggcacatacctacaccccaatcaccagttccgtgtccactatccgacagtatccagtttcagctcaggctccaaactctgccatcacagctcagactggtgttggggtagcgtctaccgtccacctaaaccccatgcagttgatgacagtggatgcatcgcatgctcgacatattcaagggatccagccagcacccatcagtacccagggtatccagccggcccccattgggaccccagggatacagcctgcaccacttggcacacagggaattcactcagcaaccccaatcaacacacaagggcttcagcctgcacctatgggtactcagcagcctcagcctgaaggaaagacttcagcagtggtgttggcagatggagccacaattgtggccaaccctattagcaatccattcagtgctgctccagcagcaacaaccgtggtgcagacccacagccagagtgctagcaccaacgctcccgcccagggctcatcgccacggccaagcatactccggaagaaacctgccacagatggtgccaaacccaagtctgaaatccacgtgtctatggccactccggtcactgtgtccatggagactgtatccaatcaaaataatgatcagcctaccattgccgtccctccaactgcccagcagcccccaccgaccattccaactatgattgcagcagccagtcccccgtcacaaccagccgttgccctttcaaccattcctggagcggtccccatcactccacccatcaccaccattgcagctgcaccacctccatcagtcactgtgggtggcagtctttcctccgtcttgggccctcccgttcctgaaattaaagtgaaagaagaagtagaaccaatggatatcatgaggccagtttctgcagttcctccactggctaccaacactgtgtctccatctcttgcattgctggcaaacaacttgtccatgcctacaagtgacctaccacctggtgcctccccaaggaaaaagcctcgaaagcaacagcatgtgatctcaacagaagaaggtgacatgatggagacaaacagcactgatgatgagaagtccactgccaagagtcttctggtgaaggctgagaagcgcaagtctcctcccaaggagtatattgatgaggaaggtgtgagatatgtcccagtgcgtccaagaccccccattactttgcttcgtcactatcggaacccctggaaagctgcttaccaccactttcagaggtacagtgacgtccgggtcaaagaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgta

SEQ ID NO: 348491 - DNA, 1235 bp, Homo sapiens
  misc_feature (14)..(14): n is a, c, g, or t
  misc_feature (26)..(26): n is a, c, g, or t
gggcagcccccatncttgtcgcctanggatccctgaaactctcccaccacttcaaggtcagtgcgtccgggcaaaggagaagaaagctatgctgcaggaaatagctaatcagaaaggagtatcctgtcgtgctcaaggctggaaagtccacctctgtgctgcccagttactacagctgacgaatctagaacatgatgtctatgaaagacttactaacctgcaggaagggattatcccaaagaaaaaagcagcaacagatgatgatctccaccgaataaacgaactgatacagggaaatatgcagaggtgtaaacttgtgatggatcaaatcagtgaagccagagactccatgcttaaggttttagatcataaagaccgtgtcctgaagctgcttaacaagaacgggactgtcaaaaaagtgtccaaattgaagcgaaaggaaaaagtctagacccagaacaatcaggagattggaagcaaatttatgaagaatgatggtgggggtggggggagggttttggttttttccaaagtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatccactcggaccatctgttatctctctacactgaaaataaaacctcttccacccaccccattcggttcttctgcctgaccttcaaatgcccatgttggccttttacagcagtgccacggcaccaagcgagctgccacatctcacactctaaagggtttgaactattagttcttgtcattttttaaaaaaaaccattcccaagtgaaattgttatatcgtctgtcttgcgtgtgtcagaactgggtttttgtggaggttcagagcaggcaacaccataagttgctctcagatccttgttctgaagtacattcttggttatctgtacttctgtagctggtgtgatgctgttaattgtatgtaccacacatctccagacgttaataaaggactcaaagaggtttttgta

SEQ ID NO: 348492 - DNA, 732 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaaggtcagtgagtggccgggccgcgacggacgtcgctcggctgtgactcgggtctgcgttcgcggccaggcggggaggccagagcgggccgccgagggcgctccccgcctgcgtcgcgcgccccacctcagactctgcccgttggttgttttttttttgcgcgcgggaatcttccttc

SEQ ID NO: 348493 - DNA, 569 bp, Homo sapiens
ggaagtgttctagaggatcccggtgttccctgtctcaaaaaaacaaacaaaaagaatgcaatagacacagaaaaaccattcagtaacatttaactcatcgttattaaaaataactttcaaaaaggtgtccttcaacaacccaaaggaaacatcccgcaatgataaaatcttagaaacagttcctgtaatggaattaacaaagatatacacgattactacttctatgaaacattatatttttgcttttcagtcactgcaaaaaaaaacatggggaaaataaaaagatattaagactagaagaaaagccataatttgcagacgatatgactgcctacagatgaagtattaaaattagtaagtgctctataagattgcccattacttgatcaacatgaaagttgtcttcccatgtaccagcaagtaacagctaggaaatgaaagtttcaaaaataggtagggcgcagtggctcaagtctgtaatcccaacactttgggaggctgaggcgggtggacctcttgacctctggagttcgagactagcctgtgcaacatgccaaaccccgtctctc

SEQ ID NO: 348494 - DNA, 1882 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagtaagtattcaaacgacttcaatgacttgcttttgaattcttcaaaatgataacttaattatccttttttaggatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348495 - DNA, 1829 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagtaagtattcaaacgacttcaatgacttgcttttgaattcttctatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348496 - DNA, 2668 bp, Homo sapiens
  misc_feature (1356)..(1356): n is a, c, g, or t
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagtaagtattcaaacgacttcaatgacttgcttttgaattcttcaaaatgataacttaattatccttttttaggatgctagaatgaatgatcttcactatcttaatctggatacatgggagtggaatgaattgtaggtatcactttagatacatttttccaaaattcagattgtttttaccctatattccctactattggtatataatgtccttgcttaacttttctttaactatgaanttaaataaacataattactaggtccttaaggaatgaattttatttttgtgtttccagttcctgtaactatgtgcctagtacatagcatgtgctcagtgtttgttgaaaggaaaaggtctgaagttgattctatcgtcaaagaaaatatttcagtataaagcatgtagtttataccaagaagcctttttaaacttaaggtctcttttttcataacatgtacatataaattttaaaagaaaacttaaaaatacagtagctgcttctaaatgcagatattgtaacttagctattattttcagaattccacaaggcatatgcccagttggtcgatcttggcactcactaacaccagtttcttcagatcatctttttctctttggaggatttaccactgataaacagccactaagtaagtccttgaaaaatatgataatgaaatcatcatatatcatccatatctaatagctgaaaatgagtctattagagactgatgagacggcttatagggttggttggaaggtttgaaattaattttgatcctgtaacatagctgtaattgtactatatggcatacttctgttcaataaagaacctggagcacttaagagccctgctgaagggctacaacatgcaaagggcttacttggctaattgcaggtgggggaaaaaaaagaaaatatactctctgtatctgctcatgatctattacctttcttgccaaagctgtgccctttaaatgtcaatgtcatattgacagactaacatacttcatttctttgcttgaatcaggtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348497 - DNA, 1523 bp, Homo sapiens
acctccagggctgctgtcatgtcaccctggtgctcacaaagccaactcactcccacccccgttgttgccattggagcgttattccggggaaggccctgttaatgttgcttgggcggtgcattcggaagggttggggtgtgaaaggtgacggtgtgtgatatcactcagacgcgttatgaggacggcctacgaggacttcaccctctggagctgggaaccgctgcccacttacagggaggccgaggtgtaggaaaactggaattccaaaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348498 - DNA, 1283 bp, Homo sapiens
cacatgttcacacctctggggcggctacagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348499 - DNA, 1875 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacaccagtagctgtcctctattaaagtaaagtaatggttgggctttttaccctgaaaaaaagttgctacat

SEQ ID NO: 348500 - DNA, 2268 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacaccaaaaaaaaaaaataaaaaaaaaaataaaaaaaaaaaaaaaaaaaagaaaaagaagaaaaaaaagaaagaaaggaaagaaagaggaaaatagaaagaagagaaaacagacggaggacagtggagagaatcagaagaagaggaccgctaggtgagagatagtagtaagaggagtaggagacaagaaaatggagatagaagggacgcgaaaaacaacagaaacgataagagaaagaaaggcgaacaaaaaaaagacagaacagaagaaaataacagaacaagaaaagagagagaaagaacaaagaagaaacgagcagagaaaacgaagcagaagcaaagaagtaggaaaaacaaaagagagagaaagaaagaaaacaagagaagaaaagaggaggaagcaaacacaaagaaaaaaaaaaagaagaaagagacaaaaagacaaagaaacagagagagaacaag

SEQ ID NO: 348501 - DNA, 2045 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggtaagtaactttgtacttggcacttagattatttaaaattgtgtttcctaagacttagcactctcgaaaaactaggtttatggattatttaagggcaataaaacttcattgctataaccagttcctatgaaaatctttgaagaaagaaagagggatgttttatgtagtttttcaagtgaatgtacttccaaacagtaaagtgaaattacttttctctttccttgtccactttcaggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348502 - DNA, 1814 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacgttacatttaagagaaagaaggcccaggagcagtggttcacgcctataatcctaggactctggaaggctcaggctgaggcgggtggatcgcttgagcccaggagttcaagaccagcctaagcaacatggagaaacaccatctctacaaaaaatataaaagttagctgggtatagtgggtgcctgtagtcccagctactcggaagactgagggggggaggatcacctgagcccaggaggtagacgttgtggagagccatgatcctgtcactgcactgggtgacaccagcctgggtgacagagaccctgtctcaaa

SEQ ID NO: 348503 - DNA, 1820 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacgtcactgcaaaaaaaaacatggggaaaataaaaagatattaagactagaagaaaagccataatttgcagacgatatgactgcctacagatgaagtattaaaattagtaagtgctctataagattgcccattacttgatcaacatgaaagttgtcttcccatgtaccagcaagtaacagctaggaaatgaaagtttcaaaaataggtagggcgcagtggctcaagtctgtaatcccaacactttgggaggctgaggcgggtggacctcttgacctctggagttcgagactagcctgtgcaacatgccaaaccccgtctctc

SEQ ID NO: 348504 - DNA, 547 bp, Homo sapiens
tctagaggatcccggctgcacaaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348505 - DNA, 1107 bp, Homo sapiens
tacatggggaaaaaacaagaactgtcaattagacttgcagtagcactgtataacaaagatgaagaaatcaaatcatccaaaaaaagcttattaaacactgataattttctcttgttaatctcagaacaaaatgctaaaggaaatgatacagtcaaaattcatgttcaaagcctgcattttttccccaagtatctaaaccaagtatagtcatgcaagtaagacttcatttgcacaaatgatctctccataaaactaccaggctttctgagactttatagtttactcaagcagggctttcaccatccctcagacgttctgtgtaaggccagttggccctacctatggaagaagaaggcatatacttcttatttcccatacgatttttattgctaacaaagacctagagaacagatcgttcagttcaaactcctcattgcataaatgagaacgaccagagagagaaaataatatccagataaaatagatattgattgatctgcttttgctactttcccttaagattttacttctcgccatgatgttttggtctgaactaccttaagatcgctagtctttatttcatagctctattctgtagtataaaatggccaactggtgttctgggtggcttcaaactcgtttttgttttaaatgcaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348506 - DNA, 1426 bp, Homo sapiens
tacatggggaaaaaacaagaactgtcaattagacttgcagtagcactgtataacaaagatgaagaaatcaaatcatccaaaaaaagcttattaaacactgataattttctcttgttaatctcagaacaaaatgctaaaggaaatgatacagtcaaaattcatgttcaaagcctgcattttttccccaagtatctaaaccaagtatagtcatgcaagtaagacttcatttgcacaaatgatctctccataaaactaccaggctttctgagactttatagtttactcaagcagggctttcaccatccctcagacgttctgtgtaaggccagttggccctacctatggaagaagaaggcatatacttcttatttcccatacgatttttattgctaacaaagacctagagaacagatcgttcagttcaaactcctcattgcataaatgagaacgaccagagagagaaaataatatccagataaaatagatattgattgatctgcttttgctactttcccttaagattttacttctcgccatgatgttttggtctgaactaccttaagatcgctagtctttatttcatagctctattctgtagtataaaatggccaactggtgttctgggtggcttcaaactcgtttttgttttaaatgcaggttatggcacacagcttgtgccagcgatgaaggagaagtaattgtttttggtggatgtgccaacaacttgcttgtccatcacagagctgtaagtatactaccttcacattattactgaaacttacttgcaaagcatttgcttttaaatgtgttcttcctatttatttttcaggcacacagtaatgaaatactaatattttcagttcaaccaaaatctcttgtacggtaagtaactttgtacttggcacttagattatttaaaattgtgtttcctaagacttagcactctcgaaaaactaggtttatggattatttaagggcaataaaacttcattgctataaccagttcctatgaaaatctttgaagaaagaaagagggatgttttatgtagtttttcaagtgaatgtacttccaaacagtaaagtgaaattacttttctctttccttgtccactttcaggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348507 - DNA, 1166 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataaggttagtgtttctaaggattatggcttgaggcatttttattcttattatctttcaaacaactgcaaatttctaaggttagccccagacttatttgtgtcacagttaaaaatgatgtgtacttgattatgatatgaatgtgcattttagtattttgtgtgccaatctgtatttacctaggcattatgtaaaatcaacttttgttggtaacctgtgtgcagtaacttcctgggtggtttttctttgtgctttttgcagctacttgttctcttagaaccttaaatgttagatgaacattagtaataaaattgcagacaaaatgaagacaagatgtaatggagggaagggtaaaaatgagcaggcaaccagtcagaaagctgtaaggataaattaaaactgacaaaactttacatg

SEQ ID NO: 348508 - DNA, 1810 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348509 - DNA, 658 bp, Homo sapiens
gagctcgagacctccatatgtcgtctggggcggctacaagagtctcatgagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataaggttagtgtttctaaggattatggcttgaggcatttttattcttattatctttcaaacaactgcaaatttctaaggttagccccagacttatttgtgtcacagttaaaaatgatgtgtacttgattatgatatgaatgtgcattttagtattttgtgtgccaatctgtatttacctaggcattatgtaaaatcaacttttgttggtaacctgtgtgcagtaacttcctgggtggtttttctttgtgctttttgcagctacttgttctcttagaaccttaaatgttagatgaacattagtaataaaattgcagacaaaatgaagacaagatgtaatggagggaagggtaaaaatgagcaggcaaccagtcagaaagctgtaaggataaattaaaactgacaaaactttacatg

SEQ ID NO: 348510 - DNA, 2288 bp, Homo sapiens
  misc_feature (1356)..(1356): n is a, c, g, or t
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagtaagtattcaaacgacttcaatgacttgcttttgaattcttcaaaatgataacttaattatccttttttaggatgctagaatgaatgatcttcactatcttaatctggatacatgggagtggaatgaattgtaggtatcactttagatacatttttccaaaattcagattgtttttaccctatattccctactattggtatataatgtccttgcttaacttttctttaactatgaanttaaataaacataattactaggtccttaaggaatgaattttatttttgtgtttccagttcctgtaactatgtgcctagtacatagcatgtgctcagtgtttgttgaaaggaaaaggtctgaagttgattctatcgtcaaagaaaatatttcagtataaagcatgtagtttataccaagaagcctttttaaacttaaggtctcttttttcataacatgtacatataaattttaaaagaaaacttaaaaatacagtagctgcttctaaatgcagatattgtaacttagctattattttcagaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348511 - DNA, 1729 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348512 - DNA, 1708 bp, Homo sapiens
aggactcggagatcaggctggccaggtggcaaatcccatgtctagtaaaaatacaaaaattagccaggcgtgatggcgagtgcgtgcagtcccagctacttaggaggctgaggcaggagaatcacttgaacccaggaggtggacattgcagtgagccagccaagattgcgccactgcactccatcctgagcaatagagacttggactaaaaaaaaaaaagttcccagagatctcttcttgtcctattgcaactgctgtatcaaaattctgaattaagagctatctatgttgagctttaccttgagtgtgtggcatgggtgggggaggattgtgcactgtaatacctatttttcatactaattatgaaattagtatctcaagatcgatttaaaaaatacagtagtgcctctttaaaataccagtttttatatttacaattttttttattcttagagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348513 - DNA, 1290 bp, Homo sapiens
catctgaggtgctctagccgatcgctgatttacgcagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348514 - DNA, 2813 bp, Homo sapiens
  misc_feature (1356)..(1356): n is a, c, g, or t
  misc_feature (2375)..(2375): n is a, c, g, or t
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagtaagtattcaaacgacttcaatgacttgcttttgaattcttcaaaatgataacttaattatccttttttaggatgctagaatgaatgatcttcactatcttaatctggatacatgggagtggaatgaattgtaggtatcactttagatacatttttccaaaattcagattgtttttaccctatattccctactattggtatataatgtccttgcttaacttttctttaactatgaanttaaataaacataattactaggtccttaaggaatgaattttatttttgtgtttccagttcctgtaactatgtgcctagtacatagcatgtgctcagtgtttgttgaaaggaaaaggtctgaagttgattctatcgtcaaagaaaatatttcagtataaagcatgtagtttataccaagaagcctttttaaacttaaggtctcttttttcataacatgtacatataaattttaaaagaaaacttaaaaatacagtagctgcttctaaatgcagatattgtaacttagctattattttcagaattccacaaggcatatgcccagttggtcgatcttggcactcactaacaccagtttcttcagatcatctttttctctttggaggatttaccactgataaacagccactaagtaagtccttgaaaaatatgataatgaaatcatcatatatcatccatatctaatagctgaaaatgagtctattagagactgatgagacggcttatagggttggttggaaggtttgaaattaattttgatcctgtaacatagctgtaattgtactatatggcatacttctgttcaataaagaacctggagcacttaagagccctgctgaagggctacaacatgcaaagggcttacttggctaattgcaggtgggggaaaaaaaagaaaatatactctctgtatctgctcatgatctattacctttcttgccaaagctgtgccctttaaatgtcaatgtcatattgacagactaacatacttcatttctttgcttgaatcaggtgatgcctggacttactgcatcagtaaaaatgaatggatacaatttaatcatccatataccgaaaaaccaaggtatttaaaagcaattcatatactgaatatgcataagacataagaattgaggttttggctgcattatatccagcattcttatttataaaaatctcagcattcactaaggtttgaaatacttctcaaagaaaagaaaaccaatgttatcctagtatcnaatgatctcctttccgtcatctgtgcatgaagagtagggctggatttttatttttgcttcttccttctgttataaaattgacacatagttaaaatatacaatcaagcttttcacttcaatgagttgaactgcatctaagtttattaaaaatgagggtcggccaggcgtggtggctcatgccggtaatcccagcactttaggaggctgaggcaggtggatcacctgaggtcaggagttccagcctggccaacatggtgaaaccccgtctctagtaaaaatgcaaaattagctgggcgtggtggcgtatgcctgtataatcccagctacttgagaggctgaggcaggacaattgcctgaaccaggaaggcagaggttgcagtgagctgagatcgtaccattgcgctccagcttgggcaacaagagtgaaactctgtctcc

SEQ ID NO: 348515 - DNA, 2129 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgtaagtatactaccttcacattattactgaaacttacttgcaaagcatttgcttttaaatgtgttcttcctatttatttttcaggcacacagtaatgaaatactaatattttcagttcaaccaaaatctcttgtacggtaagtaactttgtacttggcacttagattatttaaaattgtgtttcctaagacttagcactctcgaaaaactaggtttatggattatttaagggcaataaaacttcattgctataaccagttcctatgaaaatctttgaagaaagaaagagggatgttttatgtagtttttcaagtgaatgtacttccaaacagtaaagtgaaattacttttctctttccttgtccactttcaggctaagcttagaagcagtcatttgctttaaagaaatgttagccaactcatggaactgccttccaaaacacttacttcacagtgttaatcagaggtttggtagtaacaacacttctggatcttaaggcttcataaataatgcctatgatcaccttgcatggacagcaatcctgtaaacatcacagagtggcatcatttgtataattatatgcattgttgtagtttgcacctgttggttttaatgtgcatgtgaatggcctagagaacctatttttgtgtctaaagtttacaataaatgtatttaacacca

SEQ ID NO: 348516 - DNA, 1647 bp, Homo sapiens
cgcttccggagctcggcgggcggcgtcagcggaacgggcggcttccggccgcggcgtaaacaaggccgtggactgcaggaggcggggcagacgggctgcaagagggagccggcccgacgcggaccgcttccctgcagtgccccgagtcccgggcccgcgccgccgccgcccggctccgctcgcggcccctctgtctgcaggcgtgccccggcggcggcggagagccgtcctcggccgaggaggctgggaaacgcgagcgcaggcggcagagaggcctcaacgccgtccctttcgccaccgccttttccttgcctcgcgccgctgtgcatttctctccttttcctttgtttttttggcccctcgcgggtgtgggcattgttggttagcaaaagtgcagcctcaagatggctgatggcaacgaggatctgcgggctgacgacttgcctgggccagccttcgagagctatgagtccatggagcttgcctgccccgctgagcgcagcggccacgtagccgtcagcgacgggcgccacatgttcgtctggggcggctacaagagtaatcaagtcagaggattatatgacttttatctgcctagagaagaactatggatctacaacatggagactggaagatggaaaaaaatcaacactgaaggtgatgttcctccttctatgtcaggaagctgtgctgtgtgtgtagacagggtgctgtacttgtttggaggacaccattcaagaggcaataccaataagttctacatgctggattcaaggtctacagacagagtgttacagtgggaaagaattgattgccaaggaattcctccatcatcaaaggacaaacttggtgtctgggtatataaaaacaagttaatattttttggagggtatggatatttgcctgaagataaagtattgggaacttttgaattcgatgaaacatctttttggaattcaagtcatccaagaggatggaatgatcatgtacatattttagatactgaaacatttacctggagccagcctataactactggtaaagcaccttcacctcgtgctgcccatgcctgtgcaactgtcggaaatagaggcttcgtgtttggaggcagatatcgagatgctagaatgaatgatcttcactatcttaatctggatacatgggagtggaatgaattaattccacaaggcatatgcccagttggtcgatcttggcactcactaacaccagtttcttcagatcatctttttctctttggaggatttaccactgataaacagccactaagtgatgcctggacttactgcatcagtaaaaatgaatggatacaatttaatcatccatataccgaaaaaccaaggttatggcacacagcttgtgccagcgatgaaggagaagtaattgtttttggtggatgtgccaacaacttgcttgtccatcacagagctgcacacagtaatgaaatactaatattttcagttcaaccaaaatctcttgtacgtcagggaacctgaacagagggaccagctggagctgtggcagaggaatataaattgtgaagatttcatggacatttaccagttcccaaacaatactttcacaattctacgcctgtctacttaatctctatcctgcaagaatagtgga

SEQ ID NO: 348517 - DNA, 443 bp, Homo sapiens
taaattactttcaatgccaatcaaaagacagattgccagaatggaaaataaacaaaaactcggaatccattccactatgctgtctacaggagattcactttaggtctaaggacttacctcagggcaagtgaaaagatcgaaaaatgtattccagacaaatgtactgtggcttatgcctgtaattccagcactttgcaaggccaaggcaagaggatcacttgaggccaggccaggagttagagagcagcctgagcaacacagtgagacactgtctctaaaaaacaaacaacagcaacaaaaagccagacatggtggaaaatgcctataatcccagctacatatgaagctgagatacggagagtgcttgagccttggagttcgaggttacagtgagttacgatcatggcactacactatagcctgggtgacagggtgagatcatg

SEQ ID NO: 348518 - DNA, 528 bp, Homo sapiens
gtgaaaggtatgtctcacatggcggcagacaagagaagagagagaagcaaaagcagaacccccttataaaaccatcagaacgtgtgagacttactcactaccatgagaacagtatgggagagaccactcctgtgattcaattatctcccatggggtcccttgcacaacacgtgggaactatgggagctataattcaagttgagatttaggtggggacacagccaaaccatatcaaggggacagatactaagggaggcagaaagaccagctggtcacaggagggctctatgaaataatgaggcttgtgctcaggaaggagcagatgcaggagagaggggcagataacgagacgcaggatcacaagatctggtgactgcttggctacaagagacgagtgggcaggagaaacccatgggccacgcaggtttctggtttgcagactgggtggaagggacagtgaggccaggggttctaagcgaggaaagaataaggtattatgagcagtgagagagtcaattcagtgttaga

SEQ ID NO: 348519 - DNA, 429 bp, Homo sapiens
ctcattgttcaattcccacctatgagtgagaatatgcggtgtttggttttttgttcttgcgatagtttactgagaagctgggtgaataatctgaacgtaaggttacaggtcggcagaagtcaggcagtcatgagtgggggcagtacttttcagagtacatttgggactagatatcacagagtgtagtgctttgcttaatttcctttttaaatatcaactttttaatgaattccattccagtagtttgtattattttcttacacatggttttttgtgagagctgatagaaaccttaatcttttcaggtatttttggttagagatgttatttctgtatttctttattgtttgatatttatttttactatataatgtatctattttctctttatttagagcctaaatgttgataaatgtaaccctttcattt

SEQ ID NO: 348520 - DNA, 1488 bp, Homo sapiens
ctctcccctgtgtcccaactggggcccccttagctttcaatctaaccaccctttccagacagtctctgcttctccctccctgtggtcccctctcagccacactctgctgcaggcgagagaagcaggtccctggcctgaccctcaatgacctctttcctccccgctctctaaatacaggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 348521 - DNA, 3374 bp, Homo sapiens
aaaaaaaaaaaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccactgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccggatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcattttggaggcagcctgtcaggtcctggctctggcatcccagaagagccggaattcggga

SEQ ID NO: 348522 - DNA, 855 bp, Homo sapiens
aaaaaaaaaaaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccactgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccgaagcagtgccgggggtcctctgcga

SEQ ID NO: 348523 - DNA, 3787 bp, Homo sapiens
aaaaaaaaaaaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccactgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccggatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 348524 - DNA, 3733 bp, Homo sapiens
aaaaaaaaaaaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccactgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccggatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 348525 - DNA, 3032 bp, Homo sapiens
aaaaaaaaaaaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccactgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccggatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggtgagttttcagagggaagtgggtgtggtagggagaggagactacagctgaatatttcaggacaggtgaagtcagccaacaaagggttgatggaagctgagaaggatacagcagagatgacaaccaaaatacttaaccatcgggacagcgtatcatgctggctagagtgcaggaacaccccacctctgccaggtgctacccctttagttggcagatcacagggaggtcccagggaggtgctggtgtggctgaggcatcagaaaggcacttggaaggccgggtgtgatggctcatgcctgtaatcccagaactttgggaggcctaggtgggtggatcccttgaggccaggagttcaagaccaacctggccaacatggtgaaaccctatctctactaaaaatacaaaaattagccgggtatggtggcgggcacttataatcccagctactcaggaggctgaggcaggagaatcgcgtgaacctaagaggcggaagttgcagtgagccaagatggcgccactgcactccagcctgggtaacagggtgagactccatctc

SEQ ID NO: 348526 - DNA, 875 bp, Homo sapiens
aaaaaaaaaaaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctgttatcagagtgatccccttgaaaatggaccccacaggaaaactgaatctcactttggaaggtgtgtttgctggtgttgctgaaataactccagcagaaggaaaattaatgcagtcccacccactgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctgggtaagcacactagacctccagaccttgccctgcacttagccctactttgtcctgtggcaactcccaccaaaagcccttagactcctggagctgcgagagatcctggaaaccctctagtccaactt

SEQ ID NO: 348527 - DNA, 1260 bp, Homo sapiens
gtactattgcggccgccctctgctgcgcctgaagagagaggcgactctacaagcctcacagcatgcactgttactaaaaagacgatgcgtcctcctggacctgagatctgtgtgatcgtgggaaagcgacgaaaaacgaacaaaggaacagtaaatggagtaacttggctagaatatggcagtaactacaaggcatgttctgctctggcacgaagacaacccacctgaggcaccagacacatgagtgaagccatcttggacatcccagtcacagccaaactcactcctgagtgcatctgcatgatgaacccagcaatccccaccatggagcaaaggatccatccagtcaacccaaagaatcgtgaaaaataataaattgttgttttaaagttaaaatcagtttgggaatagcttgttatgcaacaatacataattaatacactggtctcccactttcaagtttgattaactttcagctatttttcacatagcaggcagagtgattccattaaaacatatatcagataatgtcactgcactaagtaaactctacaaggactctcatctccctcagagtaaaggtcacagttgttacaaggccctacgtaatgtggccctcaccaccactccattacctttttcttatctactatttgctaactttgctttgtcctcttttctgttctgaaacaggctaggcatggtcctgcctcaaggcctttgcaccacctactctgtctgcttggattgttcttcccacagatttcttgctcccttcttccttcatgaagaaatgtcatgaaatgtccttccttcatgaaatgtcaccttctcatttgaggccttctgtagtaccccaaagaatggtccccaaagatgtccacatccttatgcccagaacctgtgaatgtgttatcttaatggcaaaagtgactttgcaaatgtgattatatttaaggatcttaaggaggagattatcctggattatccaggagggcccaatgtaatcacaagggcccttataagtgaaagggggaggcaacagagagaaggagatgtcataatgaaaacagatccaagtgatgagattgctggctggggtggaggtggaggggggtacaatccaaggaatgcaagaagcctctaaaagctaggaaatgtcaggacacaaattctcccctagaacctgaggaagaaacccaggtttatggacactgattttaacccaataagtcccttttctgactgctgacctccaaa

SEQ ID NO: 348528 - DNA, 1299 bp, Homo sapiens
cgggccagggatgtgagaaagaagcgagccctcgagtttcctcggggcatgtgggaaggtttttttcaggatccaggcagaaccttacagagctgggagttttttaactttccattcctggcagtgacgccaggagctttaagtgatggaaatatgcgagtcaatcagtggatggtgaacaaaggaacagtaaatggagtaacttggctagaatatggcagtaactacaaggcatgttctgctctggcacgaagacaacccacctgaggcaccagacacatgagtgaagccatcttggacatcccagtcacagccaaactcactcctgagtgcatctgcatgatgaacccagcaatccccaccatggagcaaaggatccatccagtcaacccaaagaatcgtgaaaaataataaattgttgttttaaagttaaaatcagtttgggaatagcttgttatgcaacaatacataattaatacactggtctcccactttcaagtttgattaactttcagctatttttcacatagcaggcagagtgattccattaaaacatatatcagataatgtcactgcactaagtaaactctacaaggactctcatctccctcagagtaaaggtcacagttgttacaaggccctacgtaatgtggccctcaccaccactccattacctttttcttatctactatttgctaactttgctttgtcctcttttctgttctgaaacaggctaggcatggtcctgcctcaaggcctttgcaccacctactctgtctgcttggattgttcttcccacagatttcttgctcccttcttccttcatgaagaaatgtcatgaaatgtccttccttcatgaaatgtcaccttctcatttgaggccttctgtagtaccccaaagaatggtccccaaagatgtccacatccttatgcccagaacctgtgaatgtgttatcttaatggcaaaagtgactttgcaaatgtgattatatttaaggatcttaaggaggagattatcctggattatccaggagggcccaatgtaatcacaagggcccttataagtgaaagggggaggcaacagagagaaggagatgtcataatgaaaacagatccaagtgatgagattgctggctggggtggaggtggaggggggtacaatccaaggaatgcaagaagcctctaaaagctaggaaatgtcaggacacaaattctcccctagaacctgaggaagaaacccaggtttatggacactgattttaacccaataagtcccttttctgactgctgacctccaaa

SEQ ID NO: 348529 - DNA, 1326 bp, Homo sapiens
cgggccagggatgtgagaaagaagcgagccctcgagtttcctcggggcatgtgggaaggtttttttcaggatccaggcagaaccttacagagctgggagttttttaactttccattcctggcagtgacgccaggagctttaagtgatggaaatatgcgagtcaatcagtggatggtggctctcccaaacaaaatgatagacaggaacaaaggaacagtaaatggagtaacttggctagaatatggcagtaactacaaggcatgttctgctctggcacgaagacaacccacctgaggcaccagacacatgagtgaagccatcttggacatcccagtcacagccaaactcactcctgagtgcatctgcatgatgaacccagcaatccccaccatggagcaaaggatccatccagtcaacccaaagaatcgtgaaaaataataaattgttgttttaaagttaaaatcagtttgggaatagcttgttatgcaacaatacataattaatacactggtctcccactttcaagtttgattaactttcagctatttttcacatagcaggcagagtgattccattaaaacatatatcagataatgtcactgcactaagtaaactctacaaggactctcatctccctcagagtaaaggtcacagttgttacaaggccctacgtaatgtggccctcaccaccactccattacctttttcttatctactatttgctaactttgctttgtcctcttttctgttctgaaacaggctaggcatggtcctgcctcaaggcctttgcaccacctactctgtctgcttggattgttcttcccacagatttcttgctcccttcttccttcatgaagaaatgtcatgaaatgtccttccttcatgaaatgtcaccttctcatttgaggccttctgtagtaccccaaagaatggtccccaaagatgtccacatccttatgcccagaacctgtgaatgtgttatcttaatggcaaaagtgactttgcaaatgtgattatatttaaggatcttaaggaggagattatcctggattatccaggagggcccaatgtaatcacaagggcccttataagtgaaagggggaggcaacagagagaaggagatgtcataatgaaaacagatccaagtgatgagattgctggctggggtggaggtggaggggggtacaatccaaggaatgcaagaagcctctaaaagctaggaaatgtcaggacacaaattctcccctagaacctgaggaagaaacccaggtttatggacactgattttaacccaataagtcccttttctgactgctgacctccaaa

SEQ ID NO: 348530 - DNA, 1382 bp, Homo sapiens
gtactattgcggccgccctctgctgcgcctgaagagagaggcgactctacaagcctcacagcatgcactgttactaaaaagacgatgcgtcctcctggacctgagatctgtgtgatcgtgggaaagcgacgaaaaacgaacaaaggaacagtaaatggagtaacttggctagaatatggcagtaactacaaggcatgttctgctctggcacgaagatgcagtctcgctctgtcacccaggctggagtgcaatggcacgatcttggctcactgcaacctctgcctcccaggttcaagcgattcttctgcctcagcctcctgagtagctgggattacagacaacccacctgaggcaccagacacatgagtgaagccatcttggacatcccagtcacagccaaactcactcctgagtgcatctgcatgatgaacccagcaatccccaccatggagcaaaggatccatccagtcaacccaaagaatcgtgaaaaataataaattgttgttttaaagttaaaatcagtttgggaatagcttgttatgcaacaatacataattaatacactggtctcccactttcaagtttgattaactttcagctatttttcacatagcaggcagagtgattccattaaaacatatatcagataatgtcactgcactaagtaaactctacaaggactctcatctccctcagagtaaaggtcacagttgttacaaggccctacgtaatgtggccctcaccaccactccattacctttttcttatctactatttgctaactttgctttgtcctcttttctgttctgaaacaggctaggcatggtcctgcctcaaggcctttgcaccacctactctgtctgcttggattgttcttcccacagatttcttgctcccttcttccttcatgaagaaatgtcatgaaatgtccttccttcatgaaatgtcaccttctcatttgaggccttctgtagtaccccaaagaatggtccccaaagatgtccacatccttatgcccagaacctgtgaatgtgttatcttaatggcaaaagtgactttgcaaatgtgattatatttaaggatcttaaggaggagattatcctggattatccaggagggcccaatgtaatcacaagggcccttataagtgaaagggggaggcaacagagagaaggagatgtcataatgaaaacagatccaagtgatgagattgctggctggggtggaggtggaggggggtacaatccaaggaatgcaagaagcctctaaaagctaggaaatgtcaggacacaaattctcccctagaacctgaggaagaaacccaggtttatggacactgattttaacccaataagtcccttttctgactgctgacctccaaa

SEQ ID NO: 348531 - DNA, 1182 bp, Homo sapiens
gtactattgcggccgccctctgctgcgcctgaagagagaggcgactctacaagcctcacagcatgcactgttactaaaaagacgatgcgtcctcctggacctgagatctgtgtgatcgtgggaaagcgacgaaaaacacaacccacctgaggcaccagacacatgagtgaagccatcttggacatcccagtcacagccaaactcactcctgagtgcatctgcatgatgaacccagcaatccccaccatggagcaaaggatccatccagtcaacccaaagaatcgtgaaaaataataaattgttgttttaaagttaaaatcagtttgggaatagcttgttatgcaacaatacataattaatacactggtctcccactttcaagtttgattaactttcagctatttttcacatagcaggcagagtgattccattaaaacatatatcagataatgtcactgcactaagtaaactctacaaggactctcatctccctcagagtaaaggtcacagttgttacaaggccctacgtaatgtggccctcaccaccactccattacctttttcttatctactatttgctaactttgctttgtcctcttttctgttctgaaacaggctaggcatggtcctgcctcaaggcctttgcaccacctactctgtctgcttggattgttcttcccacagatttcttgctcccttcttccttcatgaagaaatgtcatgaaatgtccttccttcatgaaatgtcaccttctcatttgaggccttctgtagtaccccaaagaatggtccccaaagatgtccacatccttatgcccagaacctgtgaatgtgttatcttaatggcaaaagtgactttgcaaatgtgattatatttaaggatcttaaggaggagattatcctggattatccaggagggcccaatgtaatcacaagggcccttataagtgaaagggggaggcaacagagagaaggagatgtcataatgaaaacagatccaagtgatgagattgctggctggggtggaggtggaggggggtacaatccaaggaatgcaagaagcctctaaaagctaggaaatgtcaggacacaaattctcccctagaacctgaggaagaaacccaggtttatggacactgattttaacccaataagtcccttttctgactgctgacctccaaa

SEQ ID NO: 348532 - DNA, 356 bp, Homo sapiens
gtactattgcggccgccctctgctgcgcctgaagagagaggcgactctacaagcctcacagcatgcactgttactaaaaagacgatgcgtcctcctggacctgagatctgtgtgatcgtgggaaagcgacgaaaaacgaacaaaggaacagtaaatggagtaacttggctagaatatggcagtaactacaaggcatgttctgctctggcacgaaggaaaggctatatgaagacagagcaagaaggtagttatctacaagccaggaagagagtcctcaccaaaacacaaccatgctggtaccctgatcttcaacttccagtcttgagctgttgagaaaataaacttttattgtttaa

SEQ ID NO: 348533 - DNA, 448 bp, Homo sapiens
gtactattgcggccgccctctgctgcgcctgaagagagaggcgactctacaagcctcacagcatgcactgttactaaaaagacgatgcgtcctcctggacctgagatctgtgtgatcgtgggaaagcgacgaaaaacgaacaaaggaacagtaaatggagtaacttggctagaatatggcagtaactacaaggcatgttctgctctggcacgaaggtaaccaccactcatacctctccagccctgtgaatacgtcaattgactaagcagattccttgaggataaagtaggctcctggggaccttgcttgttgggctacttgctttgtggatgttaaacagataattctcatgagtttgagtgacgtctgatctaccagtattccccctactctgattagaaatgacttgaccatgccaaaaagaataaaagacagctctgatacaaat

SEQ ID NO: 348534 - DNA, 434 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtggtatggctgtaatcagtttactcctacttggagcttaagtggccaattcaaaaaatgtaacaaaaataagtttgcagttgcttgttcagcagtttgtagcttggtctgagttgagagagatgcactagaagacaaactgcagcctccttggttgtatg

SEQ ID NO: 348535 - DNA, 4764 bp, Homo sapiens
tgcaatcccggcacgcgcaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaacaaaaaaaaaaaaattcaaggctgtttccaaggcagcctcaaaaagagcctggtgcccagggggtccttcgtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgaaaata

SEQ ID NO: 348536 - DNA, 3255 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaacaaaaaaaaaaaaattcaaggctgtttccaaggcagcctcaaaaagagcctggtgcccagggggtccttcgtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgaaaata

SEQ ID NO: 348537 - DNA, 4178 bp, Homo sapiens
ggaaaatgacaaagtccaatgtcaatgcagattttgttcgtaattattacttatcttagctcttcagccacgctgccttgtcagtaaagtatgggacaggaagggctttgtgccattggctacatttctttctccttggccaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaacaaaaaaaaaaaaattcaaggctgtttccaaggcagcctcaaaaagagcctggtgcccagggggtccttcgtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgaaaata

SEQ ID NO: 348538 - DNA, 1156 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaagcacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgaaaata

SEQ ID NO: 348539 - DNA, 4781 bp, Homo sapiens
aacttttattaaaataaaaacaaaagtgccaaatgcacaatggtgtagtggtagcactatgagataccagaagtaacctgaatgcccagcaacatgggtcatgaagcactctgtgatcattcagaatgaagaggtagacctatgcttatgatcattcagagaagcccacaatatattgctaatttttttaaaggtaaattttaaaatattgatatgctactctgcaaatgctgagtctctggttttctagatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaacaaaaaaaaaaaaattcaaggctgtttccaaggcagcctcaaaaagagcctggtgcccagggggtccttcgtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgaaaata

SEQ ID NO: 348540 - DNA, 4896 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaacaaaaaaaaaaaaattcaaggctgtttccaaggcagcctcaaaaagagcctggtgcccagggggtccttcgtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgaaaata

SEQ ID NO: 348541 - DNA, 4168 bp, Homo sapiens
  misc_feature (36)..(36): n is a, c, g, or t
tagtcgggtatctagaggatcccgtcaggcactganagccagccctcaaacagaaacagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggcagagccagtcttctgggcctcacatgcctgtgcggttaagaaggagctcttggccgggcgcggtggctcacgcctgtaatcccagcactttgggaggccgaggcgggtggatcatgagatcaggagatcgagaccatcctggctaacacggcgaaaccccgtctctactaaaaatacaaaaaattagctgggcatggttgcaggcgcctgtagtcccagctacttgggaggctgaggcaggagaatggcctgaacccgggaggcggagcttgcagtgagccgagatcgcgccaatgcactccagcctgggcgacagagaaaaaaaaaaaaaaagaaggagcccttgaatctgagaatcccccagttaagatgatttcccttaaggagcatttctcctgatcaggtgcattcagggaggcctgcaactccatcctaaggtgacatttcaagaaacacatgtgttgaccacctctgtgtgccaagcactgggtgaggagtggtcgtatattaccataattcatcctcactcaattgggaggtggcattcttgtccctgttgcccccatctctacccccttttgttaatggttgagagaaatgtggaccagtgattctcagtttggtgcccaggtccccaaaggaagtgatggagagccttgagctaagttcaggcagcagcatgtggccagcagcagtgtgctgggagcagaggttggaatcagggctcagggccttcacttcaagggccctccccagctactcgggaggctgaggcaggagaatcgcttgaactcaggaggtggaggttgcggtgagccaagatcgtgccactgcactccagcctgggctacaagattgaaaagatcgaaactctgtctcaaacaaaaaaaaaaaaattcaaggctgtttccaaggcagcctcaaaaagagcctggtgcccagggggtccttcgtttctgtgtggctgcagaggccaggagtgcagtgactgtctcactgcctagtggttgtggctcacatcctgccctgatggagaggggggcctgtcgtccaaccctctctgaaaaactgcagtagactttaccatttcaggccccacctaatgttctttccttccttccccctacattcttcccgcccctttcatagttaagatgcataagctgagcaataaccccacttcctgatttccctgaaatatgagcccagaagcagcaggtgacagggagcttcccttaccctggggtggtggcacacagaccacctcctgtcctgtcccctgcaggtagtattcacagtgtggtgttacctgggaggagggaggaaggagctgagatgaaggagattcaggtaaacagtagccacagtggccaggacccccttcctgaggatccctgtccttcctcgcagcaggtgcttagtcctctcctagggagaagcacggaaagattcctcaaggcctcagtcccatgtccaaggcatacctaggttagaaatgtcctttacttgtttctcagttactatttctcctcttcctccctccccctgccttctcttggctgtcatttagctctctggcccacagaaatactccatccaaggagctggtcctcagtcagcctgatgaggacaggtcagtggccaacccttttgccccagtccttcatctggagacagtcacatagtcacgtcaacagttcacccaaagagaagaggtggggcctggcttctcccacagggcacagcctaactatggagacccagggctccttcctgctgcactaggcctgtgctctccctattgccttcaggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgaaaata

SEQ ID NO: 348542 - DNA, 3080 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctcgcctcttgaccgcctgtctgacagcagcagtcagggactcaaactcaaaaagagtctctccaaatccacttcccaaaactcttccgtgctgcatgaagaggaagatgagcattcctgcagcgagtcggagacacagctctctcagagaccgtcggttcagcatctcggagaggaatgtggtgtgactccagaaagtgagaatctcaccttgtcgtcatctggagctattgaccagtcgtcttgcacagggacgcctctgtcatccactatttcctccccagaaggccctgccagcagcagcttggcccagtctgtcatgtccatggcatcctcccagatcagcactgacaccgtctcctccatgtctggctcctacatcgcccctggcactgaagaggagggagaggctctctcttccccccagcctgccagcagggccccctcagaagaaggagaggggctgccagcggagtctccagacagcaactttgctggcctcccagctggagagcaggatgcagagggaaatgatgttatagaggaagaggatggatcacccacgcaggaaggccagaggacgtgcgcatttctaggtatggagtgtgacaataacaatgactttgacatcgcaagcgtgaaagcactggacaataagctgtgctctgaggtctgcttacctggtgcctggcaggctgatgacaatgccgtcagtcggaatgcccagcgccggcgcttgtcatccagcagcctggaggactctgagacgaggccctgtgtgtggggccctttggctgtctgagccccagcctctgcacttgggctcccctcctgccctgcattccatccatcctcactcagctgctgcctactgggcatcctcagcaagatgctggagactttttaccctcctgtgacagctgttacaacctgtaaccacaatccctcacctctcagagggaactggaaccctcctttctccgtgtgacctaaagccactcaatgaactgcagctcacgagaccttttgcagggactctggaatgtcctcacggtatattgatgttcaggtggagctggggtccatgggctaatttcttacacatcttttttctccttagggggtagaacaagaaggcttagagtttggcagctttgttacaaacatccctctggcatttcctggtctctggcacatcataaccaattggaaacctgcagtttggggtagggctggaggatcgctcctgtggaaagggagagccatactgcacggacgtagcgtttccctctacaagcactaggagcacctttctcaaggacaagaaatggtagcaaccaaaaggttggttgaaggaaacaatccttccttctggtggtgtgatcccggcttcctcacagagcccttttttccttctgcccagctccatcccaccagagtttctacccccgctgaggcatctcctgggcacagaccaccacactctaagccggctggcctgggagttagggtcctgcccacctcacctgggagttggggtcctgcccacctggagtttagcacgctggtcgctcactttgctttggtctgcacacctggtgtgtgcatgtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgaaaata

SEQ ID NO: 348543 - DNA, 1583 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaacaactgccccatctgccgactgcccttccgggcactgcttcagatccgagccatgaggaaaaaattgggccccttgtccccaaccagctttaaccccatcatctcatcccagacatctgactctgaagagcatccatcctcagagaatattccaccaggctatgaagtagtatctcttctggaggccctcaacgggcccctcaccccgtccccagcagttcctccacttcacgtgcttggagatggccacctctcaggaatgctcccttcatatggcagtgatggccacctgccccccgtcaggacgatctgatcagatcggactaaaggctcagctggccctgccatccttccagaggattcctctgcaactctaggcaagacaccagcttcctgggctctttatcctcatctgtgaaacttgcatgggtgcagcgaggtttcaaaccagtgtgataagtgttggcctcacacctggaccaggggatgctgggagagcaggcgcaattgttataacagaaacactgatgtgaccgaagccagtgcacacagcaggaaactgcctgtgttgaactgtctccagct

SEQ ID NO: 348544 - DNA, 1191 bp, Homo sapiens
gcggccgcggtgaagcgcggagggcggcgcgggcaccggggccgggccggggctgcagccgcagcggccatgggggccctgacgagccggcagcacgcgggcgtggaggaggtggacatcccgtctaattccgtgtaccgctacccgcccaagtccggaagctattttgccagccacttcattatgggaggagagaagtttgactcaactcatcctgaaggttacctgtttggagagaacagcgatctgaactttctggggaacagaccagttgtgtttccttacgccgccccacctccccaagaacccgtgaagactctgagaagcctggtcaatatccgaaaggacacactgaggctcgtcaaatgtgctgaggaagtgaagagccctggagaagaggccagtaaagctaaagtccactacaatgttgagttcacctttgacacagatgctcgggtagccatcaccatctattaccaggccacggaagagttccagaatggtattgccagctacattcccaaagacaacagcctccagtcggagactgtgcagtacaagcgaggagtgtgtcagcagttctgcctgccctcccacaccgtggatccctccgagtgggccgaagaggagcttggctttgatttagaccgagaagtttaccctctagtggtacatgccgtggtggatgaaggagacgagtattttggccattgccatgtactgctgggtacttttgagaagcacacagatggaactttctgtgtcaagcccctcaaacagaaacaagtagtaagtatttgaagaccacagactgttagtattagggtccttccttccttttattctttcctttcttcttctctctccctctttttttatttttgttttactttttgctctctccttttcctctttttttttttttaatcaaagaagaaaagaaaaaaagggagtgcttttgaatgttacaagctattacaaacgacttgggtggcctgaaaggaatgctgatttttgaggtcttcattgttccagaagtgttggtgttgagggagcctttatctgagcaaaggacttgagaaatgaaagaacaagatttatttcccaacattgggtttagggagaactctttttatttaaaatgccagagtgagaaacatttcaagcgaaaggataaagcattagggtcca

SEQ ID NO: 348545 - DNA, 2715 bp, Homo sapiens
gctgcggcccgaggacgcgacgcgagcccagttccggcgaggaggccgcgccagtgacagcgatggcggcggagtcggcgctccaagttgtggagaagctgcaggcgcgcctggccgcgaacccggaccctaagaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggccaagccacctcgtgacgtccggaggaggcaggaaaagtttggaacgggaggagcagctgtccctgagaaaatcaagatcaagccagccccgtaccccatgggaagcagccatgcttccgccagtagcatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtatttatatta

SEQ ID NO: 348546 - DNA, 3476 bp, Homo sapiens
gctgcggcccgaggacgcgacgcgagcccagttccggcgaggaggccgcgccagtgacagcgatggcggcggagtcggcgctccaagttgtggagaagctgcaggcgcgcctggccgcgaacccggaccctaagaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggccaagccacctcgtgacgtccggaggaggcaggaaaagtttggaacgggaggagcagctgtccctgagaaaatcaagatcaagccagccccgtaccccatgggaagcagccatgcttccgccagtagcatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtatttatattatcccccaggtttgtttttgttttttgtcctctaccacacatttagccttttatcttccaggtccttattaaaatcagatgaaagcctagtgaaagccagtctcctgccccagctcagctctgtgtggactctggtccagacagaggactgggcatctccagagcctgcacagtacctgctgcacgtagggcaaggaatgagcactagaccgcctgtccccaagggagcctcagtggggcgacagggtgctcggcggactccacctcaggccctccccactgttgctgtgcattcctgtgcaggtgcatctctttcttactaactggtatttattaagggaggtgctctgtaggtctggagcctttccctcatcctttttgcgagtccccacctttttgtttttttttttttctttgaggctcactagaggacgcagaaccttgggagattgatttgcacagaactccccacctcccacttttacaatttccagtttctgattgaaaattttagggtttctccccactgcccttccctatctttccttcctcagacctgaggaaaacccccgggggttttgtgccctgaggactttcgacctttacattccggctttatctttggttctggaatccttggaacgcagggtaagcggccagcctttggacacgcgggccggcttggaaggacactttctggcaaccctggtgttgaccgaatggtgcaggttccctcgtgtagggacttggcgcacctcggtg

SEQ ID NO: 348547 - DNA, 2815 bp, Homo sapiens
aacgctgcggagcctggactcgcggtctggtccgcgcctctcggagacgcggttactactctccggctggatatcagagcgtggacctttcgctttctcagtgaatccctttcaaaacagaataaagcctcgcgtcacctaagcatactcctgaaaacttaggttggaattgaaaaagaggcgggggcccggggttggaagtcgcagctaggtttccttttggccattaataggaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggccaagccacctcgtgacgtccggaggaggcaggaaaagtttggaacgggaggagcagctgtccctgagaaaatcaagatcaagccagccccgtaccccatgggaagcagccatgcttccgccagtagcatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtatttatatta

SEQ ID NO: 348548 - DNA, 1707 bp, Homo sapiens
gctgcggcccgaggacgcgacgcgagcccagttccggcgaggaggccgcgccagtgacagcgatggcggcggagtcggcgctccaagttgtggagaagctgcaggcgcgcctggccgcgaacccggaccctaagaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgaggatccggagtgtctgtgagaaggcatgatggagaatcccaaggtcgagagcttaaagaacgcaggtggagggggattggagaatgccactcagtaagggaagggagaaatgtttcgctggatcgcagaaagtattcattgtagaaagtcctgggaaagcttgtatctgaggt

SEQ ID NO: 348549 - DNA, 571 bp, Homo sapiens
ccctccctaaagttgaggagacagatatggaggatgaattcgagcagccaaccatgtcttttgaaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtaaccccttcagccccttggtggcttcccacccagagcacctggccctgcagagctcagaggattgccctgccactgttttccttagcttgcttttggggggcatgttgaatttcagtgtgcagtaatttcctctgggcttcactggttgtcagggtatatggtaccgcaaataagaattttctgcattattctcttgtgatgggctcatctgtatttatttcctgactgaggtggtgtcagacatgactgtggccccctccaacctggatcttcctgtgcaagatgtccagttaatgctccc

SEQ ID NO: 348550 - DNA, 421 bp, Homo sapiens
agactgattcagaactgtatgcaaagctcttatcttagtgcctaacacctgccctaatcactcttgttattaaagttctgaacttggtacgctttgctactgtgtgtcattagagatttggggcatagacacaaagtaatttagtgttaagatttgcagggtatgttgtaggaaggaagtattgcttgttgagtttctcaaagtagaaagccttatttctttagaaaaacgttagcctagttccagacccctctaacaattactttgtcaaattttaggagactggggttgggaaaacagtaaatagcttgcgaaaacacgagcatgttggaagctttgccagggacctagtggcccagtggaagaagctggttcctgtggaacggtaagaacatttctctttaggtttgttcaatttcat

SEQ ID NO: 348551 - DNA, 2647 bp, Homo sapiens
tgtatatgagatatttgatctttgcatcttgtggttaaactcaccatttctcatttgggttttcccagttttaagatttgagtatctttaagcataacctacttatcttcttcttaagaccttgttgtttctaactctgcatcttcacttctttggtgagttcagattctgtgactttgtccctcaagaagcaagatttagacctactttgtctgctttttcttttattttagaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggccaagccacctcgtgacgtccggaggaggcaggaaaagtttggaacgggaggagcagctgtccctgagaaaatcaagatcaagccagccccgtaccccatgggaagcagccatgcttccgccagtagcatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtatttatatta

SEQ ID NO: 348552 - DNA, 719 bp, Homo sapiens
gtggcgttctagacgatcccttataggtcgcaggactgatgatctcctcgatcacgtctccaggtgaccaggcccaggacctcgtagaaggggtcgccttcaccctcgttgttcaccttcgtgcacgatggccaggtgggacttccctgtgtgggggaggacactcatggaacagcttgctgggccccccccagtttgattcatctcccctggtataggcccaccaaggacacggctaacgttcatgctcctacaacgtgccaggcacagagccacactcttttctaggtttttacttaagactccctgcgaacctatgatcataaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtatttatatta

SEQ ID NO: 348553 - DNA, 269 bp, Homo sapiens
tatactgtaggattcatgtcagcatcctattcctcctcttaaggaacggctggtctcccttaaccatggtggtctgagagaatggcattttcacagcagggtttctttttggtgttacagttctttgctgtccatgttgttcttgatcactgcagggtagtctgacctgggctgtttgctcctgccttacacctgtataatgacatggaatgttctctgtttctgtatgatgcatgctctgatactgtggtgtctgagtggatttgttc

SEQ ID NO: 348554 - DNA, 289 bp, Homo sapiens
cccctttcttccatggaacaccattttttcttgaagaatgattgaaggacaaacttgttttcatacttgggtgttgacaggcattttcttgcaaataaacaagtaaacctgtcacagcaagtacaactgacattatttactgctaatcataaaattcaagctttcaagcaaaaatagaaattttggaaaactcacatatattatcaggtgcttgacagagcacacagtaggataatgaacttcattttcccagttcgttttgttttgttttgttttgagctggagtctg

SEQ ID NO: 348555 - DNA, 557 bp, Homo sapiens
tgctagaggtccctcaacaaaacaaattaggatattttcctccaatgtccaatgagctatcactgaaggacagcactccacagtgggagcccttagatccaatgctggaatttcctttatgtaagaaccttcatttctccacaatcaactttgatcaagttgctatgtctggaacaaagctctcagataattgtttatatacagtctcaaagtcatcagtctaggacatgagaggttcagcagtgaggataaaggaagaacttggtcaagcagactggggctgctgggtagtaggataagacaggttaaggcagaagagaactttcaaaacgtctacagagcagacaggatgtggctcaaagggttaccagagttgacctcttgcggctagtctctatattctccttcaaacaagccttgaccaaaggatgggccctcatttcataagcctgctagacaggagagttcaggaaaagagctgaattcttgggagctcaggacacagacccctggcttcactcttcattgctgatgttcctcaagaagagataggcatc

SEQ ID NO: 348556 - DNA, 425 bp, Homo sapiens
ggaatgatttttttcccttaatttttcaaataagtttttcccagactgttagaagaagatgatgatggtttgaccacttgggtggtgagattgggaaggattattgttctttattaaggaatatactatttattaagtaaatagtacttgttttactattttttaagcaggagaaaatttgtgaatggaagcaaaaaagccactttattttcagcctgaataagaaattaacctttgatgtcatgaaattctcttcccataaaattgataaataggaaggacaaacaagttctttttaaaaccaaaaaagaaagaatagcaaaatagaatttgttcttctttcttcatggctaggtagtctggtctgattcatagacctaaaaaagtcacataaaaacaacccaagaagtaaaagtaagcagaaa

SEQ ID NO: 348557 - DNA, 686 bp, Homo sapiens
tgtagagatggagtcttgctatgttgtccaggcaggtctcctgggctcatgcgctcctcctgacttggcctcctaaagtgctaggattagaggcgtgagttgttgagaccctcccatcctccaacttttatctcacaatctattgtgcctcctttggggacagacagtggcttcctggatggacagtggcttcccctcaggtacctggggaatttgggggcctcctccccacttaagaccagattagaaaagagagactccacctcacattctagagcgccatccccacaaatgaacaaatgagtgaatgggatgcctgttgaaaaggcaggatatagacagcctgggttcaattttagcttcaccacctcccagctgtgtgacctcagctgatttgcatgacctgtctgagcctcagcatccccaccctgtaaaatgggaatccacacagcatcccctagcccaaaggagcagggagggttgtgagaggctcgtgggtgaaaagcacagagcagagcatgggccccagtgagccctgatccatgaggtctgctagcataataattattctttccatgtgctgcacagagtggccccggaggccttagcagaaataacagaagctcccggccctttaccgtggtgatgatggtcctgaccactcattgtgggagggtgctatgggg

SEQ ID NO: 348558 - DNA, 352 bp, Homo sapiens
aacatggggagggattaacaagagatggcattaagaccttggataataaacctagttgcatctgctggtcatggtagagctgctgtggtcccttgcagcccacagtggccctgcctggaaacctcaagcaggatgtgcatcttctgcctgcctactgatctccatcacttggagtaccccaaaggcctctttttcacctcacttgcccagctgtcctagcggcataggatggttgtgtggtagaccagaggcctgttgtgtatatttttgttgggttatagccacccctgtgtatctacatgcacaagggcagagttgtagttgtggcagaagctgtagcctacaaagcctg

SEQ ID NO: 348559 - DNA, 995 bp, Homo sapiens
ctcttggagggaagctgtgttgagagaggaggctgggaagagggggacgtcctccttcaacttctttcaagttcgtatccctgagcccctgagggatccagtggcattctgggagaatgtcactgcggagtcagtgtgtagcagtttgtacttgcaacagaagcagctttagaagtacattaaaagagcccttgcggaagatgaaagtttgctgagcagatggaatgggagaatgctcttcaattcctgacaaaattatgggcagactgtttgctgacgaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcagagtctcgctctgtcacccaggctggagtgcagtagcaccatcttggctcactgcaacctccacctcccaggttcaagcagttctcctgaatcagcctcccgaataactgggactacaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacgtaagtgtggatttgtgaaacttagatccaaaacatgtcgggcttatctctgcttttatgttcaaacacatttattttctgcctccccgtttcccattctctacatggttcccatggcaggtgaataaaaagaaatctttgaaaaaa

SEQ ID NO: 348560 - DNA, 664 bp, Homo sapiens
gaaaggagaatcttaactctacttggagaacatttttatatgactttaacctaacagtaatgtgtctttggaggctcatatttacttgtctcccattgtaagcaatgcttgtctggatatccttgtactatgtatagatcactaattattgctgtagtgcaaagccctagaagccgatttgttgtatcaaaagacattgtttgaaggctttacatatctactaccaaactgtcctccagagaggtaagaacaacttatcaacagtggagtccagttctgtgcattgaggttctttctataaattattcttatccattttttgtttcttaaaacaggactaattgtacctagcacagtactgttttcataggttctgagtgtatcctattagtgataataaggtggagtccaacagtgaaaagcgaattcatgcttttttttcttgtatctttctttagatggagtccattgccttacctgtgcaataatgcttcttaataccgatctacatggccacgtaagtgtggatttgtgaaacttagatccaaaacatgtcgggcttatctctgcttttatgttcaaacacatttattttctgcctccccgtttcccattctctacatggttcccatggcaggtgaataaaaagaaatctttgaaaaaa

SEQ ID NO: 348561 - DNA, 7511 bp, Homo sapiens
ctcttggagggaagctgtgttgagagaggaggctgggaagagggggacgtcctccttcaacttctttcaagttcgtatccctgagcccctgagggatccagtggcattctgggagaatgtcactgcggagtcagtgtgtagcagtttgtacttgcaacagaagcagctttagaagtacattaaaagagcccttgcggaagatgaaagtttgctgagcagatggaatgggagaatgctcttcaattcctgacaaaattatgggcagactgtttgctgacgaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttggcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaaaaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaaatacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccagg

SEQ ID NO: 348562 - DNA, 7346 bp, Homo sapiens
tcggcagtcactgaacttgggagctgaagaatactggacggggcttcggagaggaaggatggtccaggcgcaccccagggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttggcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaaaaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaaatacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccagg

SEQ ID NO: 348563 - DNA, 7339 bp, Homo sapiens
cggccgcggcgtaggcgcacgtccggcgggctcctggagcctggaggaggccgaggggaccatgtccgggaggcgcttccacctctccaccaccgaccgcgtcatcaaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttggcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaaaaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaaatacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccagg

SEQ ID NO: 348564 - DNA, 7405 bp, Homo sapiens
tcggcagtcactgaacttgggagctgaagaatactggacggggcttcggagaggaaggatggtccaggcgcaccccagggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccaccggtggtggcttttgcagccgtagccaagattaaggctcaggatctttgaggcaagaaggaagaggagctgctaagacagctggacaacctgaaggtagacctgtcccagataatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaaagtctgtgacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttggcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaaaaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaaatacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccagg

SEQ ID NO: 348565 - DNA, 7017 bp, Homo sapiens
cagtgacgtgagctgtgcctggaacaatcagactcgctgcaaacagggtagttgaagatgctgggggaggcagcctggtgcttcttaagctaacgcggatcacggcgctcaggagctgctcaggcacaaccccgcagagttcctccagcgtgagagccttggaacggttggaaagtgcctttttatttctctaaaccccttccttagttgaccttcgaaaatgattggcgtgaatagtgtccagagtgccagcaaggtacgggtgaggacctcaggttccgtgaaatactcccgggaggattctatccggcggcagtctcacaggtcaaagtccatgaaaatttccaactcctcagagttttctgctaaggagaacaaggctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaaagtctgtgacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttggcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaaaaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaaatacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccagg

SEQ ID NO: 348566 - DNA, 6231 bp, Homo sapiens
ccgcacgtaggaagtggttacactaatagtagcgactggagggtctgctattcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaaagtctgtgacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttggcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaaaaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaaatacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccagg

SEQ ID NO: 348567 - DNA, 6553 bp, Homo sapiens
tcggcagtcactgaacttgggagctgaagaatactggacggggcttcggagaggaaggatggtccaggcgcaccccagggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccaccggtggtggcttttgcagccgtagccaagattaaggctcaggatctttgaggcaagaaggaagaggagctgctaagacagctggacaacctgaaggtagacctgtcccagataatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaaagtctgtgacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttggcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtctccgtcgaactgggtaccgagctcg

SEQ ID NO: 348568 - DNA, 705 bp, Homo sapiens
cggccgcggcgtaggcgcacgtccggcgggctcctggagcctggaggaggccgaggggaccatgtccgggaggcgcttccacctctccaccaccgaccgcgtcatcaaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacgtaagtgtggatttgtgaaacttagatccaaaacatgtcgggcttatctctgcttttatgttcaaacacatttattttctgcctccccgtttcccattctctacatggttcccatggcaggtgaataaaaagaaatctttgaaaaaa

SEQ ID NO: 348569 - DNA, 1319 bp, Homo sapiens
ctcttggagggaagctgtgttgagagaggaggctgggaagagggggacgtcctccttcaacttctttcaagttcgtatccctgagcccctgagggatccagtggcattctgggagaatgtcactgcggagtcagtgtgtagcagtttgtacttgcaacagaagcagctttagaagtacattaaaagagcccttgcggaagatgaaagtttgctgagcagatggaatgggagaatgctcttcaattcctgacaaaattatgggcagactgtttgctgacgaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcagagtctcgctctgtcacccaggctggagtgcagtagcaccatcttggctcactgcaacctccacctcccaggttcaagcagttctcctgaatcagcctcccgaataactgggactacaggaaaatgaatctacattgtcaagtgagggtcatctggattcatctcaaataaacagtgctcttagtgactccgagtagaataatgtgtggtttttgatacacttcctataatttaaagatatttttatacataaactaattccattatgtaaggaataaattacttatatctcccaatttcctcctcctataacaaattaatattaaaatgtgataacagacacaattaacagaaatctcctgtgcacaaagcaatgcaatccatagtggctttaatagagatgacagtcatgtaacaaaatgacagaagcaccctgatgcgtgtagagttttaaaacatagcctttatgatgatgtattgagtcttaagcggtctttgttttttttaaatctgaccttttaaaattggctacttgacacttggtcataatgaggaaattacctaccttcccaaggctttcttgatgtactgaccactctgttatcaccctgtcatcttttaagtggacattttttttttcttttgaaacggagtctcactctgtcgcctaggctggagtgtagtggcgcgacctcagcttactgcaacctccgcctcctgggttcaagcgattcctgcctcagcttcctgagtagctgggat

SEQ ID NO: 348570 - DNA, 370 bp, Homo sapiens
atctggtagccagcaactccaagttgacattctgtcagaatctagaacaaatgagaactaaaattctaacttaatttcttatctacataagacagtctctgtagttgcctctcatgtgcccagtaagtgcccaagtaatttgtcagtttgggaaatgaagcgaagtcttcaacagccattcacactctccaggtgggtaatacacaagtgtgctgcacacgtgcattttgaacagttttctgactaccgttgttctctggctttgccttcagaaaacccgctatgaaatgtatgtcagcattctcaaggaaggaggcaaagagctactgagtaacgatgaaagcgaggctgcaggactgaagaagtcgca

SEQ ID NO: 348571 - DNA, 219 bp, Homo sapiens
ctgttttagtgaattaaagtcattcagcacaggggattttttaaagtatgctgtgctttgttattgacttgttttttttttgaacgctaaatggcatcacgatttcctgcaggaggagcaactgaagtcacatgaaagtaagctgaagcagatcaccaccgagctggccgagcaccgctcatatccccccgacaagaaggtcaaagccaaggacgtcga

SEQ ID NO: 348572 - DNA, 624 bp, Homo sapiens
tcggcagtcactgaacttgggagctgaagaatactggacggggcttcggagaggaaggatggtccaggcgcaccccagggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatgatcagtgagtcagaggagtacaatcaacagataaaagcaacttcagctagtcaag

SEQ ID NO: 348573 - DNA, 6567 bp, Homo sapiens
  misc_feature (6550)..(6550): n is a, c, g, or t
tcggcagtcactgaacttgggagctgaagaatactggacggggcttcggagaggaaggatggtccaggcgcaccccagggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccaccggtggtggcttttgcagccgtagccaagattaaggctcaggatctttgaggcaagaaggaagaggagctgctaagacagctggacaacctgaaggtagacctgtcccagataatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaaagtctgtgacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttggcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattattttccccctaaaccattgtaaaaaaaaaaccaacccctcccctaaatttcatataataaaacaaaccgcccagaggtatatatactggtatttttttatnaaccttaaactaaatta

SEQ ID NO: 348574 - DNA, 962 bp, Homo sapiens
ctcttggagggaagctgtgttgagagaggaggctgggaagagggggacgtcctccttcaacttctttcaagttcgtatccctgagcccctgagggatccagtggcattctgggagaatgtcactgcggagtcagtgtgtagcagtttgtacttgcaacagaagcagctttagaagtacattaaaagagcccttgcggaagatgaaagtttgctgagcagatggaatgggagaatgctcttcaattcctgacaaaattatgggcagactgtttgctgacgaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagtgttgtgggattggagaagatgctgaaaccaaatgggcacctgtcctcagagatcacagactactgagaaatattggaggtgtctttctccataaaataaacagttattccatgttgaaataaaagtataagccaaattct

SEQ ID NO: 348575 - DNA, 7462 bp, Homo sapiens
cattatactcagagcctgatagctattttagctttgaaatgcccctcactccaatgatacaacagcgcattaaagaaggtggtcagttcttggagaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaaacctcacttttaactctctgccttgtttgggtaaaggcagtaactaagtttatgtttcagaactgcaaaacaaacaggatagttaccaatatggcccatgtgtcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacgagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttggcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattgctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggcggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaaaaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaaatacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccagg

SEQ ID NO: 348576 - DNA, 1853 bp, Homo sapiens
ccatccaataacttccaaggtatttatgactcatttagggctccatcaaataaaatgactaacaggatctatcataaagccacaccagccttatgttctcatctcaaaaatgctgtgacagctttttggctgctttaaccataagaaaaatgattggtggatgattttattagcccaggcttttaaaaactttcatctaggccacgtgcggtggctcacgcctttaatcccagcactttgggaggctgaggcagatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacaggtagtatctatttttctccattatttatttctagaaactcataaaatggattgtatttttctataagaacaaaatattaattaaggtatagatgactgaccaagggcttaatcaaataaaatgactaacagcatctatcataaagccacacaagccttatgttctcatctcaaaaatgctgtgacagctttttggctgctttaaccataagaaaaatgattggtggatgattttattagcccaggcttttaaaaactttcatctaggccacgtgcggtggctcatgcctgtaatcccggcactttgggaggcctgagtggatggatcacttgaggtcaggagttcaggaccagcctggccaacatgatgaaaccctgtctctactaaatatacaaaaattagttgggtgttatggtgcatgcctgtaatcccagctactcgggaggctgaggcaggagaattgcttgaactcgggaggtggagattgcagtaagccgagatcgtgccactgcactccagcctgggtgatagagcaagactgtctcaaaaaagaaaaaaaagaaaaaattttaatttaatccttctgtagaaacaggcattcagaaccattccattgatcttaataaagctgctctttactgtttctagtcaaaaatgagacttcgatcaaaccataagattttatactgcagatagtcagcttcaccaaagccgcagaggaaacatgtcgagatcaggcttcctgcttgatagtctcttgactaccattaaaacgaatattgggaggtcatgaaagtcattggtaggccattagcattgatatctttaaaacatctaccctaaaccatctgctatggacccataataagaggcctgttgtatatgaaattgtctagaattcaggtgcaggtctttgccggttaagtaagggagcaacacgtaaaatgggagaggagtggggtgtactcacttgcctcctcttttgtcctgatttaaccagcatttttcaaccctgggaaaatttgcagaatctaagttgattgtaatgattttgagctgcagcagctttaactcttaccctttttccacatagttatggtgtttgagttggaaagaaacaactataggtagctacacgtacataattatctctttattcacaaagggtatagtaaaattgattgtaaataactttctaagtgccaatattcaaaacttttggattaaaatgtatttttcaccgtga

SEQ ID NO: 348577 - DNA, 1914 bp, Homo sapiens
ccatccaataacttccaaggtatttatgactcatttagggctccatcaaataaaatgactaacaggatctatcataaagccacaccagccttatgttctcatctcaaaaatgctgtgacagctttttggctgctttaaccataagaaaaatgattggtggatgattttattagcccaggcttttaaaaactttcatctaggccacgtgcggtggctcacgcctttaatcccagcactttgggaggctgaggcagatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacaggtagtatctatttttctccattatttatttctagaaactcataaaatggattgtatttttctataagaacaaaatattaattaaggtatagatgactgaccaagggcttaatcaaataaaatgactaacagcatctatcataaagccacacaagccttatgttctcatctcaaaaatgctgtgacagctttttggctgctttaaccataagaaaaatgattggtggatgattttattagcccaggcttttaaaaactttcatctaggccacgtgcggtggctcatgcctgtaatcccggcactttgggaggcctgagtggatggatcacttgaggtcaggagttcaggaccagcctggccaacatgatgaaaccctgtctctactaaatatacaaaaattagttgggtgttatggtgcatgcctgtaatcccagctactcgggaggctgaggcaggagaattgcttgaactcgggaggtggagattgcagtaagccgagatcgtgccactgcactccagcctgggtgatagagcaagactgtctcaaaaaagaaaaaaaagaaaaaattttaatttaatccttctgtagaaacaggcattcagaaccattccattgatcttaataaagctgctctttactgtttctagtcaaaaatgagacttcgatcaaaccataagattttatactgcagatagtcagcttcaccaaagccgcagaggaaacatgtcgagatcaggcttcctgcttgatagtctcttgactaccattaaaacgaatattgggaggtcatgaaagtcattggtaggccattagcattgatatctttaaaacatctaccctaaaccatctgctatggacccataataagaggcctgttgtatatgaaattgtctagaattcaggtgcaggtctttgccggttaagtaagggagcaacacgtaaaatgggagaggagtggggtgtactcacttgcctcctcttttgtcctgatttaaccagcatttttcaaccctgggaaaatttgcagaatctaagttgattgtaatgattttgagctgcagcagctttaactcttaccctttttccacatagttatggtgtttgagttggaaagaaacaactataggtagctacacgtacataattatctctttattcacaaagggtatagtaaaattgattgtaaataactttctaagtgccaatattcaaaacttttggattaaaatgtatttttcaccgtgaaaaaaaatttggatgtatttatttcatttaaacaatttaaatggggctctttaaccaaaaa

SEQ ID NO: 348578 - DNA, 1003 bp, Homo sapiens
cggggtaaaaacaaggaagcagggatgaggagtcacaatgggatgcactcgggggatcgtttgggaggcctgagtggatggatcacttgaggtcaggagttcaggaccagcctggccaacatgatgaaaccctgtctctactaaatatacaaaaattagttgggtgttatggtgcatgcctgtaatcccagctactcgggaggctgaggcaggagaattgcttgaactcgggaggtggagattgcagtaagccgagatcgtgccactgcactccagcctgggtgatagagcaagactgtctcaaaaaagaaaaaaaagaaaaaattttaatttaatccttctgtagaaacaggcattcagaaccattccattgatcttaataaagctgctctttactgtttctagtcaaaaatgagacttcgatcaaaccataagattttatactgcagatagtcagcttcaccaaagccgcagaggaaacatgtcgagatcaggcttcctgcttgatagtctcttgactaccattaaaacgaatattgggaggtcatgaaagtcattggtaggccattagcattgatatctttaaaacatctaccctaaaccatctgctatggacccataataagaggcctgttgtatatgaaattgtctagaattcaggtgcaggtctttgccggttaagtaagggagcaacacgtaaaatgggagaggagtggggtgtactcacttgcctcctcttttgtcctgatttaaccagcatttttcaaccctgggaaaatttgcagaatctaagttgattgtaatgattttgagctgcagcagctttaactcttaccctttttccacatagttatggtgtttgagttggaaagaaacaactataggtagctacacgtacataattatctctttattcacaaagggtatagtaaaattgattgtaaataactttctaagtgccaatattcaaaacttttggattaaaatgtatttttcaccgtga

SEQ ID NO: 348579 - DNA, 1043 bp, Homo sapiens
ccatccaataacttccaaggtatttatgactcatttagggctccatcaaataaaatgactaacaggatctatcataaagccacaccagccttatgttctcatctcaaaaatgctgtgacagctttttggctgctttaaccataagaaaaatgattggtggatgattttattagcccaggcttttaaaaactttcatctaggccacgtgcggtggctcacgcctttaatcccagcactttgggaggctgaggcagatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacagactgcctgcgctgctgacttaaggccccaacaccaaacacagaagcaacagccttacacagagtgttcagcaagctccaacaattgtgtaagcagcccaagctgacagagatagaaacaacacaaggacccatcagcagacgaatggatgatcaaaacgtgcttgcaggggaatcactgaaatggggacaggccataaaaggacaaccagaagagtggcttcagcaaaggcatcgtttttcagagcaagctagagaatcctgccagcgtcctcaggcagggcccctgggcacagaggttaggcaagggagtgtcccagcatgttgatgccctgagcatcagaataatgccatagaggagcttccaaagagttcatttcaggttttgtaagccgaacatttctaggcaaataaaatttgattttgtgaaaaaagctt

SEQ ID NO: 348580 - DNA, 1307 bp, Homo sapiens
ccatccaataacttccaaggtatttatgactcatttagggctccatcaaataaaatgactaacaggatctatcataaagccacaccagccttatgttctcatctcaaaaatgctgtgacagctttttggctgctttaaccataagaaaaatgattggtggatgattttattagcccaggcttttaaaaactttcatctaggccacgtgcggtggctcacgcctttaatcccagcactttgggaggctgaggcagatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacagactgcctgcgctgctgacttaaggccccaacaccaaacacagaagcaacagccttacacagagtgttcagcaagctccaacaattgtgtaagcagcccaagctgacagagatagaaacaacacaaggacccatcagcagacgaatggatgatcaaaacgtgataggaaaaatgaggcctaaagaagttaagaaaataccatggaaatgtcactgctgaactgccatacgtaggatccgaaagaaattggaactgtataatgatgactgcacaagataccaaatcagaagaggttccatttccaagttctgattcataagagcttccaaagtagagccggtacatattgaattttgattcatctggaaggatctcggacatctctaaagaaacaagggactgatctaagccacattctccatctccagctgaatcgtcagagccactgctatggttaagaaagaccattgaagacagacttaggtcactatcagagctggaacttccatcctaaaatacacaaaaggacaaccagtttaaagatgtaaacaattttagtctcagaaataaataataacatagatagcattctattagagcaatacaagaaacttagaagcatttttcaaagagctcattaattctctaacggttttgaggcacatggtaaaaatttaactattaaaattataaagacaaga

SEQ ID NO: 348581 - DNA, 1276 bp, Homo sapiens
ccatccaataacttccaaggtatttatgactcatttagggctccatcaaataaaatgactaacaggatctatcataaagccacaccagccttatgttctcatctcaaaaatgctgtgacagctttttggctgctttaaccataagaaaaatgattggtggatgattttattagcccaggcttttaaaaactttcatctaggccacgtgcggtggctcacgcctttaatcccagcactttgggaggctgaggcagatggatcgcctgaggttgggagttcgagaccagcctggccagcatggtgaaaccctgtctctactaaaaatacaaaaattagccaggtgtggtggcgcacacctgtagtcccagctactcgggaggctgaggcaggagaattggttgaacccaggaggcggaggttgcagtgagcagagatcgtgccactgcactccagcctgggtggacagagcaagactccgtctcaaagaaacaaacaaaaaattaaaagggatagaatataatgaaatatattttgaacttaaattatattctatatgtgtatcttcctaggcaaaagctgtaatttccagagagaccattaggaacagactgcctgcgctgctgacttaaggccccaacaccaaacacagaagcaacagccttacacagagtgttcagcaagctccaacaattgtgtaagcagcccaagctgacagagatagaaacaacacaaggacccatcagcagacgaatggatgatcaaaacgtggttcactgatacctgtgttatagaaccaccatcaagtgaaaattgccataacacaggaactgtataatgatgactgcacaagataccaaatcagaagaggttccatttccaagttctgattcataagagcttccaaagtagagccggtacatattgaattttgattcatctggaaggatctcggacatctctaaagaaacaagggactgatctaagccacattctccatctccagctgaatcgtcagagccactgctatggttaagaaagaccattgaagacagacttaggtcactatcagagctggaacttccatcctaaaatacacaaaaggacaaccagtttaaagatgtaaacaattttagtctcagaaataaataataacatagatagcattctattagagcaatacaagaaacttagaagcatttttcaaagagctcattaattctctaacggttttgaggcacatggtaaaaatttaactattaaaattataaagacaaga

SEQ ID NO: 348582 - DNA, 595 bp, Homo sapiens
ttgctcttgggttctcagcatccagaactgtgagaaatgaatgtgtgttgtttaaaccactcaggctacggtattttgttgcagcagcccaagctgacagagatagaaacaacacaaggacccatcagcagacgaatggatgatcaaaacgtggtgaggtcgtgcagtgggatattattcagccgtagaaggaatgaaattctgatacatgctataatgatgaaccttgaaaacatgttaatggaaataagccaaacttaaaaggacaaatattgtataattccacttatatgagttagttacctagaataggcaaattatgtcatagatacagaacattagaggttaccagggttgtgggaagaggggtattgtgggtacaaattttcggtttggagtgattttgaaaaaattctggaaatgggtagtgacagtagtcaacatgatgaatgtacttaatgacactaaattgtacacttaaaaatggttaatactgggctggcgcagtggctcatggctgtaaatcccagaactttgggaggccaagacaggcggatcatgaggtcaggagattgagaccattctggctaacatg

SEQ ID NO: 348583 - DNA, 1359 bp, Homo sapiens
atcttgtgatgtatatctgggattgtccgaaaattatgaaatgaaagttgcatcacacttcatgaaacctcttgcggttgggctacttgaaagtgactttgaccttgtatagaaaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtagagactcctacgtgctgttatgcttctcattttatatttcc

SEQ ID NO: 348584 - DNA, 4098 bp, Homo sapiens
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttgtcgacgcggccgcgaatttagtagtagtaggcggccgc

SEQ ID NO: 348585 - DNA, 6195 bp, Homo sapiens
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttctttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtctctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaattttattctgttattggtttg

SEQ ID NO: 348586 - DNA, 2772 bp, Homo sapiens
atcttgtgatgtatatctgggattgtccgaaaattatgaaatgaaagttgcatcacacttcatgaaacctcttgcggttgggctacttgaaagtgactttgaccttgtatagaaaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttctttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtctctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaattttattctgttattggtttg

SEQ ID NO: 348587 - DNA, 3230 bp, Homo sapiens
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctgtaagtccaaggtcacattattgatgccttttcttcttttcattcacaaaagaaaatcccggatggatataatagttgtagctttgatcatgcctgtgcttcttcatctgggtatgggcctgaggactcagcacttcccctatgctctgtcaaggaaaatccaaaccctgggagaccttattaaaaggaatttgcagccaagttcagtccctcatcagggatgaagtttagcttgtatcaagtatattaaccatatcagcgtctaaacactctcactcctgcctatacaaaacctagagcattgttatattatgatgtttatagtaaggatttgcttacagaactatttatagcattatacttatggcatttttaatgcttgaagaaacattgatctgtgccaccttctgtttttaactaaataaatgcagatgcggccagtt

SEQ ID NO: 348588 - DNA, 2199 bp, Homo sapiens
  misc_feature (2166)..(2166): n is a, c, g, or t
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaccgatgcgaacgtncactttcccaccctcaccaccacacccgtcgac

SEQ ID NO: 348589 - DNA, 2453 bp, Homo sapiens
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagacctcctcaactctgtctccctttggctgcccagaaaaggtgctttcagagtgacaagcttgatatttttatttgactgagaaacgacatacttctgccccctcaaatatatatttgaccagactgtgggaattttggtgttgtatttaacttccccaccaagggcccagggctcattgcccacatgtccccacgagtagcatcaaaggctgttctcaaaaatgaaagacgaatgagcagacacagtgtgtcacatcagcaacttttttcccagtttctttgtaaatggaagtttatgaaaaggagcactaactcaaatcacagaatcctgtgtttgaaataaatggtcttgcaacaaac

SEQ ID NO: 348590 - DNA, 2315 bp, Homo sapiens
  misc_feature (1947)..(1947): n is a, c, g, or t
  misc_feature (2020)..(2020): n is a, c, g, or t
  misc_feature (2078)..(2078): n is a, c, g, or t
  misc_feature (2112)..(2112): n is a, c, g, or t
  misc_feature (2216)..(2216): n is a, c, g, or t
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgtttngtgaagctcaagctcctaatgatagcaaaaactgaacagctagtattttttcagaattgcaaaaacttctttnggggagggagtgaatgactgcagtagaaaagtttgagtcccttttatgaaaggtttgnccaattacaagaaaatatcgcatcaagaattgtnagaccatatatgaaactgaagttaactatatcaacctaatacaatgaaactctgaggttaaagtattcagtggccatccagataatcataagagaaagtgaaanataataaataatctattttcagaactttgtaacctaatagaagacataattcaaaacatgtaagctacaaagaatgtacttgagcaaagaccccaaaag

SEQ ID NO: 348591 - DNA, 889 bp, Homo sapiens
  misc_feature (1)..(1): n is a, c, g, or t
  misc_feature (847)..(847): n is a, c, g, or t
ntatattagtttactttaactactgtgcatgtcaggcagaaactaaaaattattattcctgcgcccagattcagggattactgggagcacttcctctatatatgacccttacggctcgcgacacgtcaatcatatataccaatacaatctccacgcacctcagacaatcctcactgaaaccacacatacttatcatcttaccgcctatatatcatacttattattatctttctagtgttctcatattgtgctttccacatggggcacaaatcataatataaaataattctatagtccctctaccaaatgaccccatcagaacgttcagaaactagtaccttgcgcatgacatctcagatcatttaactactcacatcatcaccagctatcgttgatctaaaccatgagatctggtatgatatactcctcaactcaattacttatcaacaacgcctactaatatatcatccgaccaaccgaacccccacgtcgtaattgttttgtatatcttgtaccctaacctccacctttcccgcctccccttttcaccacgcataataggtaaaacactttaagcccgattcctagcacaaagtcttgtcccccctatcccttctctggctctttcaatcaagctctggtggttttcttccagggcatggcccatgggaccaagcacatggtgtgtggagctgtgctctgcttcctcgtgttgatgtaacatgggctttggcagggccccaccacagatggggccccttgacatgcgtatgttttgattttgtggtgcctgcatggtaactagagctgtctgtcaaggaaattaataaatgctgacgcggccgtnaccattctcttcttatcaccctatacatttgtattgactata

SEQ ID NO: 348592 - DNA, 342 bp, Homo sapiens
agataccaagaaaagttgtaatttggatgtcggctgtcatgactttagggtgtttgcttaaaggacttttccctcactttctctccttccccagacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggtgagtccacagcaccgaggtcacctgagcttgctgtttgggaaaagcttgat

SEQ ID NO: 348593 - DNA, 810 bp, Homo sapiens
tatattaattaatcctggaaaccatcttaagatccaagaaggtactttaggatttttcatcgcaagtgatgccaaagaagttaaaaggtaagagtttattttcaactggctttctttctggcccggctgtagacaccttgacccacggaagtaggcaggcttccataaccccaaaactccttaacatgtctatggccatcaactggtgtaagaaaaacttccacggactccagttcatgtagtgaattccacatctttgaatgagaataataaaattttagaactaggaagcctagttacctgctcatttattttgtgagggagaaaatgggggctcagagagctgaatgactgctcgaggtcatcctgattcctgatgattcagaacaacataacaagacaactggctccttatctagtgctctttacttaatattatctgggaaatttacttgagaattatcagttttctactactctccctgccaaatagaatttcaaaaggttgggattaatttcagatggaatatgaaactggctctatttctatttgtggcctcctaggtaagtggctgaagttgtcagcttcaattgttaagccactgtaagtgcagcacaggatttcactggcctacatgtttcatgacatttttattcgtatccttaaacctgtttaagcagcctaggaattcacagggccctttgcagcacaacatggaatattattgtatttgattctatcttatgaacttggagaaatttactagcagaaaatgtgatgcaaatgttcagacaggtcattcagctcaa

SEQ ID NO: 348594 - DNA, 399 bp, Homo sapiens
gattcaaagctattcaatgttaaaattgtttggaacttttctaaaagaaatttcactatggattaatttccattttcttttctccttattgtttggccagtcaaggttgcagctagatcacgctattccaaagatccatttgagttcaagaaggagactcccaattctcggcttgtgaccgagccaggtgaaggaagactgggacccattcccatttttaataactaccctgcagccctcaacattctactttaccatgctgagctcagttgaagaagagcgatgcactactgtggatttcagcttgcacttagcttgttgggcagcaaaataccaaaagggaaaaccgtaaaaaacgattaataataattaaaacgacctcacccccaaactggcagc

SEQ ID NO: 348595 - DNA, 6021 bp, Homo sapiens
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtgtatccaccgccactgtgtgaaactgtatctgccactcatttccccagttggtgtttccaacaaagtaactttccctgttttcccctgtagtccccccctttttttttacacatatttgcatatgtatgatagtgtgcatgtggttgtcatttttatttcaccaccataaaacccttgagcacaacagcaaataagcagacggaccaaaagttatttatgattctgggggaaaaataacccaaaggcatgctccagacataaatagctcactgcaggaacgagttcacagattagaagggagcacttgtgatcaacgtcagttaggcagagcaagtttatttaatgtaaaagaaaagttgattctgatttatcaggattatcagggtgctttgggttttgattttgttgttgttgttgttttcctttctttctttttttatacacacaataagttagcacatgtttatttgaaacaagcaaccaaacagcaatgaaaacatattgattgtttccagtctctgggccgaagtattgcgaagcatttgaaaagctttcacgatttgtgtagatgattatgaaggacctgcttgttgcaagagaacatcagtgatttttttagttactcaccaaggccttttgtcccagagccagttccctctgggagttcttatgaacatttctcaccttaatatggaggagagaatagtattccaatcatggatgtatcaaattctagtcatttagtttaagtgaaaagaggtttgattgcatattaaattgttattctgtctccttatgttgccatatgaatagctattttttttctttcacttttgacatttgggatgaaaagccatatgtatcataaatatcagatgtaagtcattaaaaactgccttcctgggacttttacatcttttaaaaggtgaattacttaccttatgtacagaataaataatgctcaggaaagagcaagtatttttccatgcattctcaggggatctttttactcccctttgtttgattagttagggccccaatgccaggtaggaggaagggctggggcaatggtagagtgagaggaagacaaacccagctgcagatcatgcttttctaggagccgacatgctaaataaattagaatgtaggaggatcagccacagttgactcaacaaagacaaaagccagccaccaccttcaactgttggcacagctgtgcggtgctggctgtcccaatgcagaaagctggtgggaaggaattcctcatcatcactttctttaatgtagccaatttaggcagggtaatgacggcaatagagagctgctccttgtcattatgagacgtgggataagaagagtgcaacagtgagccaaacacattttggtatagttatttttttcttcttttgttttctttctttttttaacacttagtaagcatgagaggagaggtagaaaaatacccttttttcaacatatagttgtcagatgctttgtgcatgcaaatcatgctttaggcagtgcggtatttcttaaaaactggccaattcaccataaccaatttcccttatggatggactaggctggtatatacatatttgaaaagttttacttcaaagaattccatcgaatagaataggggtaaaagggaggaggaaaacatgtcacagctgtaccatctctaaaaaggtgtttttatggtgaatgttttggatttagattttggatcccccgtcccctcaagcatgatagttttggatatttgcttgctgtgtgaattgacaagcacttttactgacaaatggtgaggctcagtcagaacctccaccctcccccacaccaaagacaggggcagcgtagtattcaaaccagtattgtggtggggaataattgtatacatgtaaattatcaagccctatgagtggaagaattttttcaaattatttttgtctctctatatattgatttatattatgtataactatctctttatataaactatatataattatatatatataactatataattatatatatataactatatatataactatatatatgtatcccctagtattggatcatgaagagctcttcatgcattctttgcaaaggaggttataaagttacgccctcagaacatttataactataagaatgtgccagttaaagtgctcaacaggaaatatgacagtttaaaagcattgtaaaactcacatagcttacttctctctctaaagtgcaacaaggatgaatagaatgggccaaggtatgacaattaatggttctgcatgacctagccactgctgggggttttcttctataacgttgtccttgtgaaaacttttgtgaaattaaaaaaaaaggagttacaaattttattctgttattggtttg

SEQ ID NO: 348596 - DNA, 4133 bp, Homo sapiens
  misc_feature (3747)..(3747): n is a, c, g, or t
  misc_feature (4121)..(4121): n is a, c, g, or t
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggctcaaggttgcagctagatcacgctattccaaagatccatttgagttcaagaaggagactcccaattctcggcttgtgaccgagccagttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaagtacgtgcaggaagagcggctttgatatgtcttccttcacttcccccattgccaccccccaatcccagtncccccatcggtctgttcacatctctgtgttcatcttggcaagacctactcaatcaagtgatgatgccagttgataaacttccctggaaaacatttacagctattccatttggcaaacttgcttctctgtcaatatttcatcctcctttaaaccaggagggttattaatggcaaaagcattggtcttctttatgcttgatcagtatgactcaaattaaaagtgttctgctgtgtatatcaactcagtagcccacacccagttatctgggagctgatggttcagtcactgtattacccaaatctttcctgccagctgcctttcagacatttgttaaatcccaaccagagaccgggcagatagagagaagtaaatcngaagtgcgtttt

SEQ ID NO: 348597 - DNA, 4782 bp, Homo sapiens
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcccaagatgtccatctacaagagaatgagacgggcatgttgttttgattgcggacgttctgagcgtgactgctcatgcatgtcaggccgtgtgcgtggtaacgtggacacccttgagagagccttcccactttcttctgtctctgttaatgattgctccaccagtttccgtgcctttgaagatgagcagccgtcaacactatcaccaaaaaaaaagcaacggaatggaggcatgcggaactcacccaacacctcgcctaagctgatgaggcatgaccccttgttaattcctggcaatgatcagattgacaacatggactccaatgtgaagaagtacgactctactgggatgtttcactggtgtgcacccaaggagatagagaaagtcatcctgactcgaagtgaagctgccatgaccgtcctgagtggccatgtcgtggtctgcatctttggcgacgtcagctcagccctgatcggcctccggaacctggtgatgccgctccgtgccagcaactttcattaccatgagctcaagcacattgtgtttgtgggctctattgagtacctcaagcgggaatgggagacgcttcataacttccccaaagtgtccatattgcctggtacgccattaagtcgggctgatttaagggctgtcaacatcaacctctgtgacatgtgcgttatcctgtcagccaatcagaataatattgatgatacttcgctgcaggacaaggaatgcatcttggcgtcactcaacatcaaatctatgcagtttgatgacagcatcggagtcttgcaggctaattcccaagggttcacacctccaggaatggatagatcctctccagataacagcccagtgcacgggatgttacgtcaaccatccatcacaactggggtcaacatccccatcatcactgaactagtgaacgatactaatgttcagtttttggaccaagacgatgatgatgaccctgatacagaactgtacctcacgcagccctttgcctgtgggacagcatttgccgtcagtgtcctggactcactcatgagcgcgacgtacttcaatgacaatatcctcaccctgatacggaccctggtgaccggaggagccacgccggagctggaggctctgattgctgaggaaaacgcccttagaggtggctacagcaccccgcagacactggccaatagggaccgctgccgcgtggcccagttagctctgctcgatgggccatttgcggacttaggggatggtggttgttatggtgatctgttctgcaaagctctgaaaacatataatatgctttgttttggaatttaccggctgagagatgctcacctcagcacccccagtcagtgcacaaagaggtatgtcatcaccaacccgccctatgagtttgagctcgtgccgacggacctgatcttctgcttaatgcagtttgaccacaatgccggccagtcccgggccagcctgtcccattcctcccactcgtcgcagtcctccagcaagaagagctcctctgttcactccatcccatccacagcaaaccgacagaaccggcccaagtccagggagtcccgggacaaacagaaaaaagaaatggtttacagatgaaccggataatgcctatcccagaaacattcaaatcaagcccatgagtacccacatggctaaccagatcaaccaatataaatccacaagcagcttgattccaccaatcagagaagttgaagatgaatgttgactcccaggagaccagaactatttttttaaagcctgacaaacttcataaatggtgatgtgacttttcttcttacatgctgaatcactggtggaaacgttaggataagcaagaattgccagaaaataaagtagacagatctttctctttgtctgccttgaatattgcttccatgtattttggaaaagaaaatgatttcatttataaatgaacatactaaaatagtcatgtatagcctctagcattttaaattatttttatttattagaaagaaaatatattttttcttttcattgtcaaatatcttccctatatctaaacaatgcaaaatctaaatgaataagtggtcagactccttaatgtgtttttctcttctttctctctttttctttgaggagaatgatggtcaccaccacaattaattgtaattaagggaaatgaattattaaaacaattttaaaatggccaatgatgtatacatgtattttagtaaatccagaaaagaagactaaggggacaggtgaatacctgctcctcgcctggatgggtgtgtattttgatctgcattgacaccagctcttaataaatggaaacttatttattttcacagttgaaagtcatatttttgtagttctagttttcattctgtagttctcacccctttgttcatatttttaaagggaagaccttctgctgcttttctacaattggcagatcaggtttgtctggccaactaaggacaccaggagggttgtgggcacacctgggatgtggaagctgaggaccagatgcacacaaggcattgctctgtttgctgttctagtggtagagactcctacgtgctgttatgcttctcattttatatttcc

SEQ ID NO: 348598 - DNA, 2596 bp, Homo sapiens
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagattgaggaagacacatggcagaaatactacttggaaggagtctcaaatgaaatgtacacagaatatctctccagtgccttcgtgggtctgtccttccctactgtttgtgagctgtgttttgtgaagctcaagctcctaatgatagccattgagtacaagtctgccaaccgagagagccgtatattaattaatcctggaaaccatcttaagatccaagaaggtactttaggatttttcatcgcaagtgatgccaaagaagttaaaagggcatttttttactgcaaggcctgtcatgatgacatcacagatcccaaaagaataaaaaaatgtggctgcaaacggcgacagtggccggttctcaggatactcatcctgacagcttctaccaccaggcagtgaatgcttcctcttacctccatggtggagggcagatgtggccagttagctcctcatcttccatcctcctccactatctcaggcgacagatgccagggccagcccgccttccacttgagctttcttgtcaaggctctgccttgagcccaaatcctgacctttactgtatgaaataaagtactgatgaacaagcagaggtttgaattagagcaggcttggagcaaatgtcaagtccgtctctgcctctttcctccacctgcaccaggagcctcgattagacccagtgtggagtttgcagcgccttaggctttatgggtctggggagacataacttattaacaaagagttattaaatttttatcaattttacaac

SEQ ID NO: 348599 - DNA, 2289 bp, Homo sapiens
  misc_feature (2247)..(2247): n is a, c, g, or t
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaaggtatcttctttaatccaggctgctctcatcctgcatgggtggaactgaatggaggtggcagggaggtctgtgtagctgtgtttagagacgagaccctgaagccagatgtagccacgtgtctcccagggatcttatgttcaacatgaaaagcccagactcaggataaaggactgtcaccacgagaacttctctggctctttcaatcaagctctggtggttttcttccagggcatggcccatgggaccaagcacatggtgtgtggagctgtgctctgcttcctcgtgttgatgtaacatgggctttggcagggccccaccacagatggggccccttgacatgcgtatgttttgattttgtggtgcctgcatggtaactagagctgtctgtcaaggaaattaataaatgctgacgcggccgtnaccattctcttcttatcaccctatacatttgtattgactata

SEQ ID NO: 348600 - DNA, 2289 bp, Homo sapiens
attccggggtgtttggggtggcgctggcggcgggaggagctcccccgaagcccctgcaccggctgcccgttgctagctatggcaaatggtggcggcggcggcggcggcagcagcggcggcggcggcggcggcggaggcagcagtcttagaatgagtagcaatatccacgcgaaccatctcagcctagacgcgtcctcctcctcctcctcctcctcttcctcttcttcttcttcctcctcctcttcctcctcgtcctcggtccacgagcccaagatggatgcgctcatcatcccggtgaccatggaggtgccgtgcgacagccggggccaacgcatgtggtgggctttcctggcctcctccatggtgactttcttcgggggcctcttcatcatcttgctctggcggacgctcaagtacctgtggaccgtgtgctgccactgcgggggcaagacgaaggaggcccagaagattaacaatggctcaagccaggcggatggcactctcaaaccagtggatgaaaaagaggaggcagtggccgccgaggtcggctggatgacctccgtgaaggactgggcgggggtgatgatatccgcccagacactgactggcagagtcctggttgtcttagtctttgctctcagcatcggtgcacttgtaatatacttcatagattcatcaaacccaatagaatcctgccagaatttctacaaagatttcacattacagatcgacatggctttcaacgtgttcttccttctctacttcggcttgcggtttattgcagccaacgataaattgtggttctggctggaagtgaactctgtagtggatttcttcacggtgccccccgtgtttgtgtctgtgtacttaaacagaagttggcttggtttgagatttttaagagctctgagactgatacagttttcagaaattttgcagtttctgaatattcttaaaacaagtaattccatcaagctggtgaatctgctctccatatttatcagcacgtggctgactgcagccgggttcatccatttggtggagaattcaggggacccatgggaaaatttccaaaacaaccaggctctcacctactgggaatgtgtctatttactcatggtcacaatgtccaccgttggttatggggatgtttatgcaaaaaccacacttgggcgcctcttcatggtcttcttcatcctcgggggactggccatgtttgccagctacgtccctgaaatcatagagttaataggaaaccgcaagaaatacgggggctcctatagtgcggttagtggaagaaagcacattgtggtctgcggacacatcactctggagagtgtttccaacttcctgaaggactttctgcacaaggaccgggatgacgtcaatgtggagatcgtttttcttcacaacatctcccccaacctggagcttgaagctctgttcaaacgacattttactcaggtggaattttatcagggttccgtcctcaatccacatgatcttgcaagagtcaagatagagtcagcagatgcatgcctgatccttgccaacaagtactgcgctgacccggatgcggaggatgcctcgaatatcatgagagtaatctccataaagaactaccatccgaagataagaatcatcactcaaatgctgcagtatcacaacaaggcccatctgctaaacatcccgagctggaattggaaagaaggtgatgacgcaatctgcctcgcagagttgaagttgggcttcatagcccagagctgcctggctcaaggcctctccaccatgcttgccaacctcttctccatgaggtcattcataaagctgtaatcacatatggattcttttatatgggtcttggcatggactgaacaaagagaaaggcagcacagaaagattacataacatatacacagagtccggtgcccagcgaggatggggcccgagaagcggcaatggtcaggacttaatgcgaaaatccagtagaagctgacactcaccctggcccttctcggctggcaggatatagtcactgatgtgaaataagagccatcttattgaacaagcctctggccaagcatcagtctgagctctttcagagataattggcctttaattaattgcatgcattcctgagtccacctgggtatccacagactgggtctactctgcctccccactcttccaaatttttgactttggttttttgagtgccatccactgttagtgattgttacatgaaaatcgcaaagtcctatgtaagccataaggaataaaatatcagat

SEQ ID NO: 348601 - DNA, 356 bp, Homo sapiens
gctgaggcaggagaattgtttgaacctgggaggcagaggttgcagtgatctgagatcgcgccattgcactccatcctgggcaacaagagtgaaactctgtcttggaaaaaagaaaaaaaaaaagataactgtccaacaatgctgtggttgtttttttcatttgttttcgttaaagtttgttatggtgctaggattattataagaagtgggaacaatagctaatatttattgagtgtcaactatttgccaggctcagggctaagccctttacactcattatctcatttagccctgctgcaagcctgtgattcacgcgctttcattatctctgtgctaatgaggaggaaagtgaggtt

SEQ ID NO: 348602 - DNA, 503 bp, Homo sapiens
tgtgcccccgcctggctgcgctcaccgtggcatcctgcccggcgtagtggctgatgacccgggagccccctggatgccggcgggtgaactcgctgatgttgtacaccttacggtcgatcactagccaccgctcctcgcaccctgagcgctgggccacctcgtcccagtttctcccgtacatcccagtccagccccagcctctggagttatctttctacaccatggatctgatcacagtacacctgctttacggatgtccaagcctcctccatggacctaccctggctggtactgtgctgggagccgctggggaccccaggccctggccggtccacgcttctcagccaccctacacaggccacccatacgtgctcccttttagggcctgaaccttcaaagcctctgtgagatactccctggttctgcctttcagctatcactccctgctccgagctccacaccctttacaaatgttcattaaagttatctatatggtatgttaa

SEQ ID NO: 348603 - DNA, 2158 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtcttgtttattgctatatgccttggcacctaacaatgcctagcataccataaatggccctatatctgtgtgtctaatgaatgaactatgagtgaaatactatctgtgatgtaaag

SEQ ID NO: 348604 - DNA, 1734 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttctccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348605 - DNA, 2111 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348606 - DNA, 2446 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccaggtgagaccccatgggaagcgcctccgggagcgacggggtccgcttggcgctgggggccgtggggagccggggtctggagtgcgcgggattcgcagtcaagaggtcccgccacttttccccctgtgagccttgggccagtcgcgtaagctccgagcctctctttcctccattgtagaaaagcgtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348607 - DNA, 2211 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagttaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348608 - DNA, 1241 bp, Homo sapiens
ctctgaaagtcgatctgacatagtgatgcatgcttggaatgtggcggccattgtacaagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348609 - DNA, 1335 bp, Homo sapiens
  misc_feature (32)..(33): n is a, c, g, or t
  misc_feature (96)..(96): n is a, c, g, or t
  misc_feature (126)..(126): n is a, c, g, or t
  misc_feature (133)..(133): n is a, c, g, or t
  misc_feature (142)..(142): n is a, c, g, or t
  misc_feature (156)..(157): n is a, c, g, or t
aaaggtcaagttgtacaaacagcagtgtttgnntaaaacggacggccatgtaaccttcataacgtgtccttaacgggtagctgaagtgcctggtgntgtgctgaaacttcctgtgcaccgcagtgnacgaagncgatactgnacggtcagcagtcnnggtgcgcgtcagtagttactggagcgctcgcagagcaagatagcaccgtgatgtcgcagatgagattcgggcgtccactaaggcgtaggggcttcatcggcagcctacgttacttgtgtagacctagcaggttggctgtgatcctcgagcaggtttctgtcggtagtcatgtagaggtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348610 - DNA, 395 bp, Homo sapiens
tttttgttgtgtggaatttagttgaaggcatgaagttggtgagataacaccagttataacctttctcctttcctccgtctctgacttgcctttcttttttagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccaca

SEQ ID NO: 348611 - DNA, 407 bp, Homo sapiens
aaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagt

SEQ ID NO: 348612 - DNA, 182 bp, Homo sapiens
caccgctcctcgcaccctgagcgctgggccacctcgtcccaggtgaagtagcgcggggtaggtccctgagccgcggtctcggcggccaccgggtcgggggccatagctggcctggcgacgccgcgcgccgggccagcaggggctgtcaggcgcgtgctcggggtccgcgggctccaggagtg

SEQ ID NO: 348613 - DNA, 2264 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348614 - DNA, 687 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtttctcccgtacatcccagtccagccccagcctctggagttatctttctacaccatggatctgatcacagtacacctgctttacggatgtccaagcctcctccatggacctaccctggctggtactgtgctgggagccgctggggaccccaggccctggccggtccacgcttctcagccaccctacacaggccacccatacgtgctcccttttagggcctgaaccttcaaagcctctgtgagatactccctggttctgcctttcagctatcactccctgctccgagctccacaccctttacaaatgttcattaaagttatctatatggtatgttaa

SEQ ID NO: 348615 - DNA, 2188 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgaggacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348616 - DNA, 2000 bp, Homo sapiens
gtaagcctggtgaatcggacgagggagcttaggacgtcgccggagcaccgaacaagcttagccgcgaggccggtgtccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348617 - DNA, 2099 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348618 - DNA, 1990 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaagcagtgagcggcgggctgaggcagagaagcagctgcagcaggctcaggctgctggggccgagcaggaggtggaaaaattcactaagcggctggtgaaggtcactaagcagcacaatgatgagtgcaaacatctgctgagcctcatgggcatcccttatcttgatgcacccagtgaggcagaggccagctgtgctgccctggtgaaggctggcaaagtctatgctgcggctaccgaggacatggactgcctcaccttcggcagccctgtgctaatgcgacacctgactgccagtgaagccaaaaagctgccaatccaggaattccacctgagccggattctgcaggagctgggcctgaaccaggaacagtttgtggatctgtgcatcctgctaggcagtgactactgtgagagtatccggggtattgggcccaagcgggctgtggacctcatccagaagcacaagagcatcgaggagatcgtgcggcgacttgaccccaacaagtaccctgtgccagaaaattggctccacaaggaggctcaccagctcttcttggaacctgaggtgctggacccagagtctgtggagctgaagtggagcgagccaaatgaagaagagctgatcaagttcatgtgtggtgaaaagcagttctctgaggagcgaatccgcagtggggtcaagaggctgagtaagagccgccaaggcagcacccagggccgcctggatgatttcttcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348619 - DNA, 1653 bp, Homo sapiens
agtcctgcgatttcgggtgtagagggagcaggggcctgcggggacctggtgtgggtggagtggggacaagcggtggagaagggtacgccagggtcgctgagagactctgttctccctggagggactggttgccatgagagcagccgtctgaggggacgcagcctgcactacgcgccccaagaggctgtgcgtggcgagcaggtcacgtgacgggagcgcgggctttggaaggcggctgaacgtcaggccacccgccgctaagctgagaagggagagcgagcttaggaccgcctgcccggggcaaccccgaaccaagctttagccgccgaggccgcgtgtcccaaaggccagtcatccctcctctgtgttgccatgggaattcaaggcctggccaaactaattgctgatgtggcccccagtgccatccgggagaatgacatcaagagctactttggccgtaaggtggccattgatgcctctatgagcatttatcagttcctgattgctgttcgccagggtggggatgtgctgcagaatgaggagggtgagaccaccagccacctgatgggcatgttctaccgcaccattcgcatgatggagaacggcatcaagcccgtgtatgtctttgatggcaagccgccacagctcaagtcaggcgagctggccaaacgcagtgagcggcgggctgaggcagagaagcagctgcagcaggctcaggctgctggggccgagcaggaggtggaaaaattcactaagcggctggtgaaggtcactaagcagcacaatgatgatcaaggtgaccggctcactctcttcagctaagcgcaaggagccagaacccaagggatccactaagaagaaggcaaagactggggcagcagggaagtttaaaaggggaaaataaatgtgtttccccattatacctccttcaccccagaatatttgccgtcttgtacccttaagagctacagctagagaaaccttcacggggtggagagaggattctaaggcttttctagcgtgacccttttcagtagtgctagtcccttttttacttgatcttaatggcaagaaggccacagaggtacttttccttttttagctcaggaaaatatgtcaggctcaaaccacttctcaggcagtttaatggacactaagtccattgttacatgaaagtgatagatagcaacaagttttggagaagagagagggagataaaagggggagacaaaagatgtacagaaatgatttcctggctggccaactggtggccagtgggaggtgatggtggacctagactgtgcttttctgtcttgttcagccttgacccaccttgagagagagccaccaggaaggcgcatcttagcagatgggaggaactgctgagagaagatgggcagaaagctggagcccctggagttggctgtgtctgtgtttgtgactgattactggctgtgtcttgggtgggcagaaactcgaacttgctatgtaatttgtgtctagttattcagaggagtaagatggtgatgttcacctggcaatcagctgagttgagactttggaataagacactggttttcatgcgctgtttttgttttaaagttatgaagaaaaaagtcaataaaattctaaaagtaaaaaaaaaaacatgtt

SEQ ID NO: 348620 - DNA, 762 bp, Homo sapiens
aatgaatgattgcttcctgtcaactgggaaaggaggaagaaaaccatgaaattgaaaacaaacgtgtttagcagtaagattcctatccgctgggttcatgacccatgttctgactagttatcacaattgaatttatctcaaggacacatgagaggaaaccgttggtatgtggggggtggctggagaggaatgatgatagaggaggaaagtacttgtagtgtgactttcctcagagtcaagagaaggaagtgcttgcagcaataaaagtatttaaatataaactgaagaacacctctggttcttgtttttggtagatggagaaacccagagcagagctgaagaggtgtcatctgctctccagatggagtcagctgacaactcagaagcagaaaccaggtcttctgactctgggcaaatgttagatgctccctttagtagcaggaagacctgggtggaaatcctgatttggagtgtggtttgttgggcttcaacagttcacttgtctggtttctcctaaaagacatttgatttcacagatgtttaatttcttttgggaaaggaaactggacttcattgtcaagcttgagagaagagccaggcttaccatttctcctttctttctgagttttagcaaaggaagtctcaagctcttcaggtaaagagatgaggaccaggaaatgggtggtggtaaaggagtagtttagctcagtagtaggtaaacaagaaagagaaaaaaattcaaaggaatgaaaaattcctcag

SEQ ID NO: 348621 - DNA, 2282 bp, Homo sapiens
acaactggcctgaccttcaaaggccttcacagctcctgccttcatgttaccgtctactatgttcctcgtgcaccttccactcagcacaaacaggctgcactgcctccgaaacacatcacttgaatcctacctctgctcctttgtccatctgaatcaccctctccacatttctgaccgtgtaatcctgatctcacttcatgaggcagttcgcttctcttttgcatttagctttccccggggtacactgtcaatagcctactgtctgatgtcatcagtcagcacttcatcagaggcaattatgtccacagagcttttggctaattactgtcactcctctttacatgtgtgcatatgcatatcatctttccctaatgagactggaaatcatgattcattccctggagcagtggtttccataagtgaccaacccacagaccagtgcaaactggctgcaaaagagcttcctctgaggaacttattagaatgcagattctttgactgcatgggagaggaggatctcataaatctgggtgtaataggcacagaacgttaggtgtaatatgggcgggactctggactcagcatatccaacaagctgctggctgattccgacgatgccgatgaattgccaggttgggaactgctgcccccagagaacctagcagagagctctgtacgtggtaggtgctcactcccctattgtttgggtgtatgcctcctgataatgaacttgatcgtaactttattgttgtattatgcctgtattgtttccttaagtgaaggaagaatgcttttgagtacctaataggtggcaagctctgtgcctacttacatacatgaactattccttttaataacctttggaaataaagtggcatttccattgggcattagaaatctgaagactttcgtttacagctgttgcaacagcagaactagaattcgacctccgacatttctgctcaccagagggcatgaactgctggtttgtacctggcttgcagataccttctttgggcagcacaatgttcaaaattaaaaaaactaccaacacttctaaactggatactttgtatcaatatctgggtttctggcttctcttcacgggaaaaaaacaaacaaacaaaaaggtttggtgaacactggggcccacattcctgcagggcaacagtcacatggagactttagatgggcacgtgcccagaacacactagagtccccatcgctccccattctcttacattctgttcccaactaggttcttataggcctgggtttgtgcctgttgcacacttatctactctcttgcttcccactggtcaggaagtctggcaaacttaaaaggcctctttttgttgctctcttctgtatggatctctcatcatagaggtgtgtgcatttctgactttgtgatttcaatactaaggaagctgtcggcagattatcaaggaaaacggggatcgctgctccccaacgtacacattctggtgtgccccagtaaaattctatattcagcctccaaactagctgggaaaaatgtggcaaatcatctacttgctccaattcaatggtgtttagaagtaggaagtcactgtgagcaatgccaccaagtggtggagagactccatgcagaatcgccaccttcagccagagaggctgggaggccgaagacctctctcaatgcacagggccattcagaaactagaaacaaaatgcttgctcatctccctaggccactccttccgaggctttttgagacggggtctcactgtcacccaggccggagtgcagtggcacaatcaaggctcactgcagcctcaaccttctgggttcaagcgatcctcccacttcagcctttcaagtggctgggatgactacaggcatgggccaccacagccagctgattttttttttctttttagtagaaatgaggtctcgccatgttgctcagactggtcttgaaccaacacatctttagctttttaaaagacagccttggccagccatggcagctcacacttgtaatcactgcactttcggaagctgaggtgggcagatagcttgagccgaggagttcgagaccagcctgggcaacgtggtgaaaccccatctctacaaaaaatacaaaaattagctgggtgtgatggtgcacatctgtggtcccagctgctggggaggctgaggtgggaggattgcttgggcctgggaggtcgaggctgcagtgagctgtgattacctcactgcattccagcctgggcaacagagaaccctgtctctattta

SEQ ID NO: 348622 - DNA, 1695 bp, Homo sapiens
cccgcgccccgccccgcgcagcgctgggccagggacgcacccccaccgcgtcgtaggaaaattacctggtgtggggggtggggcggaaggcacctcctatactccgactccgcctgggccacccgcccctcaccctcggcctgacccagcctctccgtgcctcccctagccgcctcctcccagcagtcccccaggagcgagctgcgagatgccccaaatcggacccctccccagttggaaaaaaaacgactcctgacctttcccagcctcctcggtccgctgaggaacccgcagccccgggcctcgagcagactgctgggactgcggggcggccgggcgcggggccagaggcggggcggggcgggtcgggtcgggggcctttaagaggcgcggtcgccgggaccgacacagacgcggacagcgccgggactcgccgccccgggactcgcgcagcccgcagcgctccggctcctcctctcgcgaccgccctccgcagcgatggacggagacggtgacccagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaccttcaccgactacgggccgggcgtccgcttcgtccgcttcgagcacggggggcaggactccgtctactggaagggctggttcggggcccgggtgaccaacagcagcgtgtgggtagaaccctgagcgaccctgcctccgctctcccccagctgcctggaggggcaaaggtcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaagga

SEQ ID NO: 348623 - DNA, 1731 bp, Homo sapiens
cccgcgccccgccccgcgcagcgctgggccagggacgcacccccaccgcgtcgtaggaaaattacctggtgtggggggtggggcggaaggcacctcctatactccgactccgcctgggccacccgcccctcaccctcggcctgacccagcctctccgtgcctcccctagccgcctcctcccagcagtcccccaggagcgagctgcgagatgccccaaatcggacccctccccagttggaaaaaaaacgactcctgacctttcccagcctcctcggtccgctgaggaacccgcagccccgggcctcgagcagactgctgggactgcggggcggccgggcgcggggccagaggcggggcggggcgggtcgggtcgggggcctttaagaggcgcggtcgccgggaccgacacagacgcggacagcgccgggactcgccgccccgggactcgcgcagcccgcagcgctccggctcctcctctcgcgaccgccctccgcagcgatggacggagacggtgacccagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaccttcaccgactacgggccgggcgtccgcttcgtccgcttcgagcacggggggcaggactccgtctactggaagggctggttcggggcccgggtgaccaacagcagcgtgtgggtagaaccctgagcgaccctgcctccgctctcccccagctgcctggaggggcaaaggtcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaaggaaggaatgaatgaaaaaatggataaacactgctccct

SEQ ID NO: 348624 - DNA, 1321 bp, Homo sapiens
aggcctcatccctgctctgccatttatctcgggagagcatggtgcctctcccagcctgtttccttctctgtaaatggatgccttacctccaggggtcactggggcggtccaaggagcttgggacacatcaggtactttaataaaagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaccttcaccgactacgggccgggcgtccgcttcgtccgcttcgagcacggggggcaggactccgtctactggaagggctggttcggggcccgggtgaccaacagcagcgtgtgggtagaaccctgagcgaccctgcctccgctctcccccagctgcctggaggggcaaaggtcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaagga

SEQ ID NO: 348625 - DNA, 1674 bp, Homo sapiens
cccgcgccccgccccgcgcagcgctgggccagggacgcacccccaccgcgtcgtaggaaaattacctggtgtggggggtggggcggaaggcacctcctatactccgactccgcctgggccacccgcccctcaccctcggcctgacccagcctctccgtgcctcccctagccgcctcctcccagcagtcccccaggagcgagctgcgagatgccccaaatcggacccctccccagttggaaaaaaaacgactcctgacctttcccagcctcctcggtccgctgaggaacccgcagccccgggcctcgagcagactgctgggactgcggggcggccgggcgcggggccagaggcggggcggggcgggtcgggtcgggggcctttaagaggcgcggtcgccgggaccgacacagacgcggacagcgccgggactcgccgccccgggactcgcgcagcccgcagcgctccggctcctcctctcgcgaccgccctccgcagcgatggacggagacggtgacccagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaccttcaccgactacgggccgggcgtccgcttcgtccgcttcgagcacggggggcaggactccgtctactggaagggctggttcggggcccgggtgaccaacagcagcgtgtgggtagaaccctgagcgaccctgcctccgctctcccccagctgcctggaggggcaaaggtcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaagga

SEQ ID NO: 348626 - DNA, 1367 bp, Homo sapiens
cccgcgccccgccccgcgcagcgctgggccagggacgcacccccaccgcgtcgtaggaaaattacctggtgtggggggtggggcggaaggcacctcctatactccgactccgcctgggccacccgcccctcaccctcggcctgacccagcctctccgtgcctcccctagccgcctcctcccagcagtcccccaggagcgagctgcgagatgccccaaatcggacccctccccagttggaaaaaaaacgactcctgacctttcccagcctcctcggtccgctgaggaacccgcagccccgggcctcgagcagactgctgggactgcggggcggccgggcgcggggccagaggcggggcggggcgggtcgggtcgggggcctttaagaggcgcggtcgccgggaccgacacagacgcggacagcgccgggactcgccgccccgggactcgcgcagcccgcagcgctccggctcctcctctcgcgaccgccctccgcagcgatggacggagacggtgacccagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtgagagggtcctggggtggcatggggctgggaggagcggggtaaggcagaggggagagccagctggggaaccccccgcctgggggtgctgcctccccactgcaggggttgaggccacgtgggccacgggtctgcaaaggttgacaacttccgtgtttgcaggagaacctggaaacccacctcccctcctgagttttaaatgttggcaaatatatgcacatatatatgtttgtatatatgtaatgtatatat

SEQ ID NO: 348627 - DNA, 1381 bp, Homo sapiens
acgccagcgaagccctagaggcggtctccaaagagcacgtctctctgctatcttggtctggcgggaggccttgagaggcgactggcaaggagagagaactcctgggtcccatttagccaggaagtagcaccagaggacccccacattcccgcctcccagcttcctgaggggatcagctataccctggactctggggcccactccagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaccttcaccgactacgggccgggcgtccgcttcgtccgcttcgagcacggggggcaggactccgtctactggaagggctggttcggggcccgggtgaccaacagcagcgtgtgggtagaaccctgagcgaccctgcctccgctctcccccagctgcctggaggggcaaaggtcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaagga

SEQ ID NO: 348628 - DNA, 1518 bp, Homo sapiens
cccgcgccccgccccgcgcagcgctgggccagggacgcacccccaccgcgtcgtaggaaaattacctggtgtggggggtggggcggaaggcacctcctatactccgactccgcctgggccacccgcccctcaccctcggcctgacccagcctctccgtgcctcccctagccgcctcctcccagcagtcccccaggagcgagctgcgagatgccccaaatcggacccctccccagttggaaaaaaaacgactcctgacctttcccagcctcctcggtccgctgaggaacccgcagccccgggcctcgagcagactgctgggactgcggggcggccgggcgcggggccagaggcggggcggggcgggtcgggtcgggggcctttaagaggcgcggtcgccgggaccgacacagacgcggacagcgccgggactcgccgccccgggactcgcgcagcccgcagcgctccggctcctcctctcgcgaccgccctccgcagcgatggacggagacggtgacccagagagcgtgggccagcccgaggaggcaagcccggaggagcagccagaggaggcgagtgctgaggaggagcggccggaggaccagcaggaggaggaggcggcggccgccgccgcgtacctggacgagctgcccgagccgctgctgctgcgcgtgctggccgcactgccggccgccgagctggtgcaggcctgccgcctggtgtgcctgcgctggaaggagctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaaggaaggaatgaatgaaaaaatggataaacactgctccct

SEQ ID NO: 348629 - DNA, 1012 bp, Homo sapiens
  misc_feature (1)..(1): n is a, c, g, or t
  misc_feature (12)..(12): n is a, c, g, or t
  misc_feature (14)..(14): n is a, c, g, or t
nctaaataaccntnattaaagggaagtagcttgcggtcatattctccttcttctgctggtggacggcgccccgctgtggctgctcaagtgccagcaggaggggctggtgcccgagggcggcgtggaggaggagcgcgaccactggcagcagttctacttcctgagcaagcggcgccgcaaccttctgcgtaacccgtgtggggaagaggacttggaaggctggtgtgacgtggagcatggtggggacggctggagggtggaggagctgcctggagacagtggggtggagttcacccacgatgagagcgtcaagaagtacttcgcctcctcctttgagtggtgtcgcaaagcacaggtcattgacctgcaggctgagggctactgggaggagctgctggacacgactcagccggccatcgtggtgaaggactggtactcgggccgcagcgacgctggttgcctctacgagctcaccgttaagctactgtccgagcacgagaacgtgctggctgagttcagcagcgggcaggtggcagtgccccaagacagtgacggcgggggctggatggagatctcccacaccttcaccgactacgggccgggcgtccgcttcgtccgcttcgagcacggggggcaggactccgtctactggaagggctggttcggggcccgggtgaccaacagcagcgtgtgggtagaaccctgagcgaccctgcctccgctctcccccagctgcctggaggggcaaaggtcgagggtagataggccttaacttagtccatagcgtcctcaccttccccaagccacacatcctcctcccatcccttgctccgatcccagcccctgagcagggagagagaagttttgttggcataggtttgcttaggtagccggcttctagaatgtagatccgtgagggcgtgagcttggactggacccactgctgattccctgcacctagcacagtgcttgccacaaagtgggctctcaataaatattatttgtccaagga

SEQ ID NO: 348630 - DNA, 1312 bp, Homo sapiens
gaaaatgatattatctattttaccttgcagccttgttttaaagtttagtggtaatagctatgaagtgtctggtattgggcaatcatagaaaactggtagctcttaatattaaatgtttttcttttttagttataagggtaaattaaccacggttgctccaatgggcagctggttgatccaactaatttaccatttagactttatggccactagggatttattcttttacatgatttactaatgttttaagccgagcaaatttttgcattagggaaatatgtttgtattggagaagtaaatgaggttttatttaactttatttaaaatatgtgctaatttataacttttcttcatgttatcttaataaagacttgataaagaaggaaatggatataaaatattgaacttgtaagtattttgacagagtacattacttcttctcattaaagtaggtagacgaacagaggttggcaaactatgttgggtcagctgctggttttgtaaataagattgtattagaacacagccactctcatctatttacaaattgtctatggccattttagcactgcagaggcagagctgaattgcaataccatgtggcccagaagcctaaaatatttactatctgtacctttaaaaaaaagtgttacttagaaattttttgagtaagtatatgttcttaagaattatgtattaaacattgtttaatattttgttttgaattggcattttactaagagattcaatttctgaggctataaaaagaattttacataacaacaatcttgaagggaatctaagcaaagaaatctcatttcatcaattgagagacaagagtgtggcctcaagccaaacaacttggaatccaatcccatctccatcattactagttttgagatcttgaacaagttccttacatttctgtgccaattttctcgtctgtatattggggataataataggatttctctcataggattattatgaggattaaatgagtagaagttgtaaagtgcttggaacaatgtctgatacacaacaggaggtgctcactatatttagccattatcataatcatcatcatttaaatggaaacaaaatccctggtttctaataaattgtggatactcaataaataatagctgaatctgaatatgaacagtgattattacagaaaattgggatgatttaattgaagggtttgcatatttagtgtaaggactgcacttgagttctgatgacatctttccataagggaatacatattttctttcatcttcctctcccactgccacactggtctttctca

SEQ ID NO: 348631 - DNA, 1081 bp, Homo sapiens
agcgagttttgagtgtcaaatttgcacttaatttgtttttggtactgtcataaggactgtagcatacacagcatactacaactgtaactttttacgaaaatatacattttttgaagatgacttcagaaactgagggagagagacccacttgagactaggcagcaaacagtgaagaagaaatgagcaacatggtgtgcaggagcaaagtttcctactgtatatctctactctaagtgtacaatgcctataaatggaaagtatgctttcttggctttcctttagcctattttccaagcaagaactattgttgttggtaatttaggtgcatggaatagtaagttgaagtcttgaattcttatttaataataatacacttaatacattgtcagtgtttaattttgtcttcccattgttcttattcctgctagttttcacaaatagaaaacttacattgaaggggaaaattgccttaatgataattgtgggtgtgttttttcctctatcttttatttttaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggacttta

SEQ ID NO: 348632 - DNA, 3052 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtgtaaaaaaaaaaaaaaaaaaaaattatttttacgttgttagatatggggagtagtgtgattgaggtggagtagattaggcgtaggtagaagtagaggttaaggagggtgatggtggctatgatggtggggatgatgaggctattgttttttgtgaattcttcgataatggcccatttgggcaaaaagccggttagcg

SEQ ID NO: 348633 - DNA, 2894 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagacttgataaagaaggaaatggatataaaatattgaacttcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgt

SEQ ID NO: 348634 - DNA, 4423 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtctatttgtgtattgtagatgtatcaagtgatttctaatttttttcacatatgaatgtgccagattactctagaactagatgtctcttctttaaataattttagttttcctgaataaatttgtaatggttaaagtaccaagtaagtaaggcgagaagggattctgtttttaaaatcacatcagaacttttcctctactaagattataaattaaatgtaaaatactcctaattgcaattcttaaacttaggccttacatgtacttattatgcaactgctcctggactctattcaccatagatatcagtaaacgtatgtcccaggattcacaggcttttgattaatcaatattcttttcaagtttgctgtgaagagtttagttctcttcaaaatttcttaactaatctgatttttaagaattctctttgcagtgtttagcttcctattcacattcttaaaattgctttggtgttaccatgagtctaaaatgaagtttagccttccttttgtttcattctgagaacttctatattatattacctttaaaaattgtttatgatattaaatttaaaatacaaacagctctctttttttttttttttttttttaatcatccagcccaaagtggcaaaaacagctcttttctcatttggcaccaccaataacgcaagttaaaaataatgttgagtttattatacttttgacctgtttagctcaacagggtgaaggcatgtaaagaatgtggacttctgaggaattttcttttaaaaagaacataatgaagtaacattttaattactcaaggactacttttggttgaagtttataatctagatacctctactttttgtttttgctgttcgacagttcacaaagaccttcagcaatttacagggtaaaatcgttgaagtagtggaggtgaaactgaaatttaaaattattctgtaaatactatagggaaagaggctgagcttagaatcttttggttgttcatgtgttctgtgctcttatcatcacacaggtcatgtgttgttactcaggattctggaagtactaagccgtagttaacaggctggatagatcttcagccaatcttctttcattatactgctgcttttctgtttcttaaaaaacaaaaatcaatgaacaacttctttagaaggaagcaccactgttcaattggttaactgaaagtatgaatcactgccgctttgcttgcccacctgtttgctttttctcacaggttttatttatctgaatgattgttgcatttgaatactgtagccatggtgagtgagcagttgaagacttcctttctgcaccttcatagttaagggttcatcttctcaagaaataaagttgtgctgggttgtttcaattctgtagatcacctagaaactaggtaacaaggcccttggatcacaatgagcacattgcaggtctttggaaatgctgggaaggggttacattcaagtaactgctgacgtccttcctctctgtcagacccatgttggcctgtaattatatttttctgaatctaaaaacaaatagaaatttctgatatcttttc

SEQ ID NO: 348635 - DNA, 3048 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtgtaaaaaaaaaaaaaaaaaaaaaaaaaaaaaaaaaaaaaaaaaaaaaaaccttgtggcccgcttgggcccatccgatttttagcctgggccagctttttccttgcgcccgaatttgggcctcattggcccatttccccttatggggggccgtttaccattcaattgcccgcgttttaacaccgtcggaccggg

SEQ ID NO: 348636 - DNA, 3860 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtctatttgtgtattgtagatgtatcaagtgatttctaatttttttcacatatgaatgtgccagattactctagaactagatgtctcttctttaaataattttagttttcctgaataaatttgtaatggttaaagtaccaagtaagtaaggcgagaagggattctgtttttaaaatcacatcagaacttttcctctactaagattataaattaaatgtaaaatactcctaattgcaattcttaaacttaggccttacatgtacttattatgcaactgctcctggactctattcaccatagatatcagtaaacgtatgtcccaggattcacaggcttttgattaatcaatattcttttcaagtttgctgtgaagagtttagttctcttcaaaatttcttaactaatctgatttttaagaattctctttgcagtgtttagcttcctattcacattcttaaaattgctttggtgttaccatgagtctaaaatgaagtttagccttccttttgtttcattctgagaacttctatattatattacctttaaaaattgtttatgatattaaatttaaaatacaaacaaaaaaaaaaaaaaaaaaaaaaaaaaaaaaaaaaaaaaaaaaaaaaaaaaaaaaaggggggggggggtaaaaaatatccccggggggggcccattgggcccccttttttttaaaagggggcgcccaaaagggggggaataaaagggggggggggggtaaaggtcgggcgggggaaaaacttctgctattgggaacttcttcggggaaagacccccctttgctggcggggggacctctatgggcgaccaccccccagaaaatataagagaccccggggaaaaaaaacttcggtgtttatggtcacccacagcttatgccgcgggaaaattggtcccgtttttttcgatatagggcggtcttaattcagataaaagagaacaaacacaaaataaacagagaacaaaagtgcgcaaagaatatgcaaaca

SEQ ID NO: 348637 - DNA, 2457 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccaggtttgtatgtgagctgggtttagtattgaataaggttcttatctgtgtaatattcaaaggattgattttctataattagttgtttgagaggcaatacagccttagaggctaaaggggctaaagcctggactccagttccgtcttctccacatactagctgtgtggccctgtgcaaggttcttaatctcttgatgctccagctttcttatttgtgaaatgggattacagtagaacctcccttatgagggtgttaaaatagtaaatacttggtaaatataaagtatgtataatagtgcctgactcaaatgatcagaaagttttaactcatttttattcatgctaagggtcattttatttaataatatgctttagaaaaatattttttctctgatgataaaagaaaaatgtaatattctggcgtacaatatactggttggaaaat

SEQ ID NO: 348638 - DNA, 1609 bp, Homo sapiens
agcgagttttgagtgtcaaatttgcacttaatttgtttttggtactgtcataaggactgtagcatacacagcatactacaactgtaactttttacgaaaatatacattttttgaagatgacttcagaaactgagggagagagacccacttgagactaggcagcaaacagtgaagaagaaatgagcaacatggtgtgcaggagcaaagtttcctactgtatatctctactctaagtgtacaatgcctataaatggaaagtatgctttcttggctttcctttagcctattttccaagcaagaactattgttgttggtaatttaggtgcatggaatagtaagttgaagtcttgaattcttatttaataataatacacttaatacattgtcagtgtttaattttgtcttcccattgttcttattcctgctagttttcacaaatagaaaacttacattgaaggggaaaattgccttaatgataattgtgggtgtgttttttcctctatcttttatttttaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgt

SEQ ID NO: 348639 - DNA, 2864 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagatggaatcttgctctgtcgcccaagctggagtgcagtggcgagatctcgggtcactgcaacctctacctcctgggctcaagcgattctcctgcctcagcctcccgagtagctgggactacaggcgcacgccaccacacccagctaatttttgtatttttagtagagacggggtttcaccatgttggtcaggatggtctcgatctcttgaactcgtgatccgccctccttggcttcccaaagtgctgggattataggcgtgagccaccgcgcccggcccacagcatcatttttcaagggtctctagggtgaccaggtgtccgggtttgccaaggacagtcccagtttctacctgctgtcctaggacaatcatgaatagtgcccctttcagtttcaaaagtgtcatagtttagacattaaattacctgaccacccttatatgccccatgtttcttaacatctaggctgctgacaaaattcacattttctgactgtcagtctagtgttctctatactagactgatacggatccacaaaggaagcaatattggccaacaattaatcttcagtctttggattagtgagaggtgacaacgtgctggcagccgtcacagccctcgctcactctccccgcctcctctgcctggtttcccagtttgacggcacttgaggagcccttcagcccgccgctgcactgtgggagccccttcctgggctggccgaggccggaggcggctcccccagcttgcggggaggtgtggagggagaggcgagggcgggaacaggggctgcgcgcggtgcttgcgggccagcgcgagttctgggtgggtgtgggctcggcgggccccgcactcggagcggccggcaggccctgccggccccgggcaatgaggggcttagcacccgggccagcggctgcggagggtgtgccgggtcccccagcagtgcc

SEQ ID NO: 348640 - DNA, 2083 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtggtaggtcttttatgatatgtttgcatatgatgtttgaaacttgaattttaagactgtatacataccaacaatataggattgaagtgtgagacaattaggttgtttaatcatgactttaaactctgctatttgataccggtaggaagttagggtatcaaaattaataaatgcttgatatacctcaaagagttagaattcattaagtcctataacacttcagctatttacatatatacacaaacttacaaacacacacaggttgggaagttcttcagaatttagcattgcctcatgctcaaaattatgaatagagttattttacactgtgatatatgtatatacaaaggctagtaaatatccagataagagtttactgtatgcattgatttttttcaaataagtgttttgcagttttatattcatataaatgaggttaagtattattttgtcaagtactcagtatatttctacagaatttctggttgtattatttatagtttctttttaaagatagaaactgaaaactgtgcttaagatttcacatagaataatgatggagtaaataaagtattgttattttgggctaagctgggattagagacttgtctgagttagaactctaacatgtagaatttaaaaaatgaatttctgtgatattttatgtgtacatcattggaagtagcctaatccaaggttttttaaatatgagcctttaagattcaaatttgtactgagcatcttaaacccctaaacaatgaaatgctaatgtcaatgttattagcctgattataaaatttttttaatgtcatgattttgcctttcatactcattaaaatagcccatttttctccattccctggctctactaataacactattctttatagcagatttaaagatatgtgcagataa

SEQ ID NO: 348641 - DNA, 959 bp, Homo sapiens
gtcacattcataagttcttagtactccaaatttgagtatccagttattaagtatgtatacagtgaaaataggtatttcaattttaagataatttgctttttaaaatgtaaactatagaaaactaaaactgtgaaattataatctaatcacatttctgtggtttctgtttttagcttgataatggaactatacagcgaagagacaatctctggcaagtttttgtagaaaaaatgtttcagtgcctagtctgaaaaataacagtttgagttctttgaaactcttatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgt

SEQ ID NO: 348642 - DNA, 468 bp, Homo sapiens
caaaaaacgctaacttgggacaagttcttgggaaattttatcctagtgttggttctgccactgacttgcatcctgtccacatagcttcaggcaatggaataaataaggtttgaggttccttttcagctctaaagctttccttaattactgcttttttttttcttaagagttccagaagacagcgaacagtgtgagagtctcatttctatgcacagtgtttctcaggaggatggagctagttagctgtctgttgtctgtagcccaggtttgtatgtgagctgggtttagtattgaataaggttcttatctgtgtaatattcaaaggattgattttctataattagttgtttgagaggcaatacagccttagaggctaaaggggctaaagcctggactccagttccgtcttctccacatactagctgtgtggccctgtgcaaggttcttaatctcttgatgctccagctt

SEQ ID NO: 348643 - DNA, 2490 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggtaggcaggcagggaagggccccgacatcaccggagcccaaaccgagacggagtgcccaccagcagcaccacctcctgccctcggtggcagcaggagcgccttgaccgaaaccgtgaaggtctctaggggcggagggagcgggagctgacaggggcgcccgagccctgcgcccaccgctggcaattgaggaagccgtgcgtgcgccctcgcctcggctccccggggaggcgtcgctgccttaactgtcttccccgctccaaaacagaaggatgatttcttttcccagctgtttcttttaaaatgactggatgttttgatagaggtgggtggaggagcatggagaatccttttcttttaccacttgaagagattggaaaggtgccttcaagacccacagcaaatcacttactctccgataaccaaattccactccagcagatcagggacagaaaagacacttttagaaacagtgtctagacgctgtccccagggatggattcctctggatggagaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtggtaggtcttttatgatatgtttgcatatgatgtttgaaacttgaattttaagactgtatacataccaacaatataggattgaagtgtgagacaattaggttgtttaatcatgactttaaactctgctatttgataccggtaggaagttagggtatcaaaattaataaatgcttgatatacctcaaagagttagaattcattaagtcctataacacttcagctatttacatatatacacaaacttacaaacacacacaggttgggaagttcttcagaatttagcattgcctcatgctcaaaattatgaatagagttattttacactgtgatatatgtatatacaaaggctagtaaatatccagataagagtttactgtatgcattgatttttttcaaataagtgttttgcagttttatattcatataaatgaggttaagtattattttgtcaagtactcagtatatttctacagaatttctggttgtattatttatagtttctttttaaagatagaaactgaaaactgtgcttaagatttcacatagaataatgatggagtaaataaagtattgttattttgggctaagctgggattagagacttgtctgagttagaactctaacatgtagaatttaaaaaatgaatttctgtgatattttatgtgtacatcattggaagtagcctaatccaaggttttttaaatatgagcctttaagattcaaatttgtactgagcatcttaaacccctaaacaatgaaatgctaatgtcaatgttattagcctgattataaaatttttttaat

SEQ ID NO: 348644 - DNA, 2855 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgt

SEQ ID NO: 348645 - DNA, 3567 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggtaggcaggcagggaagggccccgacatcaccggagcccaaaccgagacggagtgcccaccagcagcaccacctcctgccctcggtggcagcaggagcgccttgaccgaaaccgtgaaggtctctaggggcggagggagcgggagctgacaggggcgcccgagccctgcgcccaccgctggcaattgaggaagccgtgcgtgcgccctcgcctcggctccccggggaggcgtcgctgccttaactgtcttccccgctccaaaacagaaggatgatttcttttcccagctgtttcttttaaaatgactggatgttttgatagaggtgggtggaggagcatggagaatccttttcttttaccacttgaagagattggaaaggtgccttcaagacccacagcaaatcacttactctccgataaccaaattccactccagcagatcagggacagaaaagacacttttagaaacagtgtctagacgctgtccccagggatggattcctctggatggagaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtgtaaaaaaaaaaaaaaaaaaaaattatttttacgttgttagatatggggagtagtgtgattgaggtggagtagattaggcgtaggtagaagtagaggttaaggagggtgatggtggctatgatggtggggatgatgaggctattgttttttgtgaattcttcgataatggcccatttgggcaaaaagccggttagcg

SEQ ID NO: 348646 - DNA, 4368 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtctatttgtgtattgtagatgtatcaagtgatttctaatttttttcacatatgaatgtgccagattactctagaactagatgtctcttctttaaataattttagttttcctgaataaatttgtaatggttaaagtaccaagtaagtaaggcgagaagggattctgtttttaaaatcacatcagaacttttcctctactaagattataaattaaatgtaaaatactcctaattgcaattcttaaacttaggccttacatgtacttattatgcaactgctcctggactctattcaccatagatatcagtaaacgtatgtcccaggattcacaggcttttgattaatcaatattcttttcaagtttgctgtgaagagtttagttctttcctattcacattcttaaaattgctttggtgttaccatgagtctaaaatgaagtttagccttccttttgtttcattctgagaacttctatattatattacctttaaaaattgtttatgatattaaatttaaaatacaaacagctctctttttttttttttttttttttaatcatccagcccaaagtggcaaaaacagctcttttctcatttggcaccaccaataacgcaagttaaaaataatgttgagtttattatacttttgacctgtttagctcaacagggtgaaggcatgtaaagaatgtggacttctgaggaattttcttttaaaaagaacataatgaagtaacattttaattactcaaggactacttttggttgaagtttataatctagatacctctactttttgtttttgctgttcgacagttcacaaagaccttcagcaatttacagggtaaaatcgttgaagtagtggaggtgaaactgaaatttaaaattattctgtaaatactatagggaaagaggctgagcttagaatcttttggttgttcatgtgttctgtgctcttatcatcacacaggtcatgtgttgttactcaggattctggaagtactaagccgtagttaacaggctggatagatcttcagccaatcttctttcattatactgctgcttttctgtttcttaaaaaacaaaaatcaatgaacaacttctttagaaggaagcaccactgttcaattggttaactgaaagtatgaatcactgccgctttgcttgcccacctgtttgctttttctcacaggttttatttatctgaatgattgttgcatttgaatactgtagccatggtgagtgagcagttgaagacttcctttctgcaccttcatagttaagggttcatcttctcaagaaataaagttgtgctgggttgtttcaattctgtagatcacctagaaactaggtaacaaggcccttggatcacaatgagcacattgcaggtctttggaaatgctgggaaggggttacattcaagtaactgctgacgtccttcctctctgtcagacccatgttggcctgtaattatatttttctgaatctaaaaacaaatagaaatttctgatatcttttc

SEQ ID NO: 348647 - DNA, 2327 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggacttta

SEQ ID NO: 348648 - DNA, 1996 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagcttgttaatggaactttacagcggagagacaatttttggcaagttttggagaaaaaatggttcagggcctaatctgaaa

SEQ ID NO: 348649 - DNA, 2284 bp, Homo sapiens
gagccctcgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagacttgataaagaaggaaatggatataaaatattgaacttgtaagtattttgacagagtacattacttcttctcattaaagtaggtagacgaacagaggttggcaaactatgttgggtcagctgctggttttgtaaataagattgtattagaacacagccactctcatctatttacaaattgtctatggccattttagcactgcagaggcagagctgaattgcaataccatgtggcccagaagcctaaaatatttactatctgtacctttaaaaaaaagtgttacttagaaattttttgagtaagtatatgttcttaagaattatgtattaaacattgtttaatattttgttttgaattggcattttactaagagattcaatttctgaggctataaaaagaattttacataacaacaatcttgaagggaatctaagcaaagaaatctcatttcatcaattgagagacaagagtgtggcctcaagccaaacaacttggaatccaatcccatctccatcattactagttttgagatcttgaacaagttccttacatttctgtgccaattttctcgtctgtatattggggataataataggatttctctcataggattattatgaggattaaatgagtagaagttgtaaagtgcttggaacaatgtctgatacacaacaggaggtgctcactatatttagccattatcataatcatcatcatttaaatggaaacaaaatccctggtttctaataaattgtggatactcaataaataatagctgaatctgaatatgaacagtgattattacagaaaattgggatgatttaattgaagggtttgcatatttagtgtaaggactgcacttgagttctgatgacatctttccataagggaatacatattttctttcatcttcctctcccactgccacactggtctttctca

SEQ ID NO: 348650 - DNA, 1471 bp, Homo sapiens
ctccacggtgcgcggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaatgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgaca

SEQ ID NO: 348651 - DNA, 4456 bp, Homo sapiens
gccttcttcctgtgtggaaatacagcgcctccggcttgaacctgccactcaggtgtcttgatgtgtcgggggtgtggctgcctgccccctgatgctccctgccccaccctgtgcagtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagtgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagcaagtgtctttgaagtctttgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacccttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaatgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgaca

SEQ ID NO: 348652 - DNA, 4267 bp, Homo sapiens
gccttcttcctgtgtggaaatacagcgcctccggcttgaacctgccactcaggtgtcttgatgtgtcgggggtgtggctgcctgccccctgatgctccctgccccaccctgtgcagtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagtgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagcaagtgtctttgaagtctttgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacccttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaatgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgaca

SEQ ID NO: 348653 - DNA, 4437 bp, Homo sapiens
cacctgcgccgcgccccttcactgcgttccccgcccctgcagcggccacagtggtgcggccggcggccgagcgttctgagtcacccgggactggaggtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagtgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagcaagtgtctttgaagtctttgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacccttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaatgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgaca

SEQ ID NO: 348654 - DNA, 4376 bp, Homo sapiens
cacctgcgccgcgccccttcactgcgttccccgcccctgcagcggccacagtggtgcggccggcggccgagcgttctgagtcacccgggactggaggtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagtgcccaccccaagcgccgagaggaagatgtacgtcccatcttctgggcctccagaccaaagagttacatctaccgtacccaggagtgggacgagttccctaacggccgctgagcaagtcccccaaggaggagctgctgaagatgtggggggaggagctgaccagtgaagcaagtgtctttgaagtctttgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacccttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaatgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgaca

SEQ ID NO: 348655 - DNA, 239 bp, Homo sapiens
cgtcagcttcatgttctggaaggtaaaggagccgggggcaagcttgccccgcccacctggaaaaccgtggggagggattgggaccaagtcccaagcgtgtactgaaggccacactggacccagccttcagggcacacccagctctgactcacccatgtcactgctgacgcagggtgtttatttctgggcaggggtgggaagtgatactggcagtgggccttgttctattccgggaaatg

SEQ ID NO: 348656 - DNA, 283 bp, Homo sapiens
cttccagggactcgcagtcctgggtgtcggggctaggtagagggaacagaaagggtctctggaggttgggtgagacccagtgactatgacctccaccaaccctgcagacccaataggtgaccagtgggaagaggaggagggaggcttcaactacgcagtggacctggtgaagcacatccgaagtgagtttggtgactactttgacatctgtgtggcaggtgagtggctggatcatcctggtggcggggatggagctagggaggctgagatgcccagagagcct

SEQ ID NO: 348657 - DNA, 764 bp, Homo sapiens
gctgcggggctgtgacttccccatcctgtgccctcccctccatgctgtggacatggcaaagggagaagggtaagttgggagacctccacctggaagggcttagggaggcaaagacaggctgggtctttgttgggggccgtgagagggactcagggtgccaaacctgatggtcgccccagccagctcaccgtctctcccaggtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggtgtggtagggaggcacggggtgcccccctctcttgaccggcacccgtgggttccccagagcttagggcagagcagcctgcctctcctgggctcttaaattttgaatgagcatggattggagcggatgggagctcatgctttaagtcagatagacctggctgggcacggaacccggccagcactttgggaggccaaggcgggtggatcacttgagcccaggagttcgagaccagcctgggcaacatggtgaaacccattctctacaaaaaatacaaaaatgaccgaggcatggtggtgtacacctgtagtcccaggtacttagggggctggggtgagaggatcgcttgagtccgagaggttgaggctccagtaagccatat

SEQ ID NO: 348658 - DNA, 3099 bp, Homo sapiens
ctccacggtgcgcggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgcaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagaggttaaggtgggtccaggaaggcagctgctcttagtgcccgcctaggagttgagtacagtgaggagggtggaggaaggtgctgagcttagccttgtgccctgcccccatctccccaggcctccagcctctcccggctgcctgccgcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgcgggtctgaaggaatagccagagaggagcacctgaaccccatgggcttggacttcctggggccccgctgggatttcttcgctgctctagctggcaggacacatcccggcctcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaatgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgaca

SEQ ID NO: 348659 - DNA, 2901 bp, Homo sapiens
gccttcttcctgtgtggaaatacagcgcctccggcttgaacctgccactcaggtgtcttgatgtgtcgggggtgtggctgcctgccccctgatgctccctgccccaccctgtgcagtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggagacccaataggtgaccagtgggaagaggaggagggaggcttcaactacgcagtggacctggtgaagcacatccgaagtgagtttggtgactactttgacatctgtgtggcaggttaccccaaaggccaccccgaagcagggagctttgaggctgacctgaagcacttgaaggagaaggtgtctgcgggagccgatttcatcatcacgcagcttttctttgaggctgacacattcttccgctttgtgaaggcatgcaccgacatgggcatcacttgccccatcgtccccgggatctttcccatccagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacaccctcaaccgcgagatggctaccacagaggtgctgaagcgcctggggatgtggactgaggaccccaggcgtcccctaccctgggctctcagtgcccaccccaagcgccgagaggaagatgtacgtcccatcttctgggcctccagaccaaagagttacatctaccgtacccaggagtgggacgagttccctaacggccgctggggcaattcctcttcccctgcctttggggagctgaaggactactacctcttctacctgaagagcaagtcccccaaggaggagctgctgaagatgtggggggaggagctgaccagtgaagcaagtgtctttgaagtctttgttctttacctctcgggagaaccaaaccggaatggtcacaaagtgacttgcctgccctggaacgatgagcccctggcggctgagaccagcctgctgaaggaggagctgctgcgggtgaaccgccagggcatcctcaccatcaactcacagcccaacatcaacgggaagccgtcctccgaccccatcgtgggctggggccccagcgggggctatgtcttccagaaggcctacttagagtttttcacttcccgcgagacagcggaagcacttctgcaagtgctgaagaagtacgagctccgggttaattaccaccttgtcaatgtgaagggtgaaaacatcaccaatgcccctgaactgcagccgaatgctgtcacttggggcatcttccctgggcgagagatcatccagcccaccgtagtggatcccgtcagcttcatgttctggaaggacgaggcctttgccctgtggattgagcggtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaacggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacccttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagca

SEQ ID NO: 348660 - DNA, 1205 bp, Homo sapiens
cacctgcgccgcgccccttcactgcgttccccgcccctgcagcggccacagtggtgcggccggcggccgagcgttctgagtcacccgggactggaggtaggaacccagccatggtgaacgaagccagaggaaacagcagcctcaacccctgcttggagggcagtgccagcagtggcagtgagagctccaaagatagttcgagatgttccaccccgggcctggaccccgagcggcatgagagactccgggagaagatgaggcggcgattggaatctggtgacaagtggttctccctggaattcttccctcctcgaactgctgagggagctgtcaatctcatctcaaggtttgaccggatggcagcaggtggccccctctacatagacgtgacctggcacccagcaggtgaccctggctcagacaaggagacctcctccatgatgatcgccagcaccgccgtgaactactgtggcctggagaccatcctgcacatgacctgctgccgtcagcgcctggaggagatcacgggccatctgcacaaagctaagcagctgggcctgaagaacatcatggcgctgcggggaggtgtggagccagcactcccctacactctgggttctggctttcccggaggccacttggtagcctgaacttggttcctgaaatggtcctttacttcttcctgggccccacgctgaggatccgcaggatcccatccccgccagtagtgtcagtaggcattgtgggtagtgagtcatcctgggcaccacacacaggcagccacctcttccacctcttgacctcgacataggagttccgtcaggaatgcagtcgcggcctgataaccctctgccttgcctacaccactgcatcgattgctggctgcacccagcacttggcccaatcacagagtaacagagtatccaggagtgagaatagccggtcaggcctctggtgcccgctgttgtcaggccacctaagagtgggaagagggagcctgatgggtgggatcctatggcctcgtgctccctaccacaagaccccttcacttgagatgagtagaaaattctcccaggaggcaggagccccaaggccgtgggatgggagagggtggcaggcatgcccaggtagaagtagggaagggctctccaatcctccaggcacggtgagaagcagcggtggtctcctattctccaccgccagca

SEQ ID NO: 348661 - DNA, 280 bp, Homo sapiens
ggaggagtcaggggcagaatttacaggaatggcctcctgggcatgtggtggcactgccctctgtcaggagtgtgccctgacctctgggcacccctctgccaggggcaattcctcttcccctgcctttggggagctgaaggactactacctcttctacctgaagagcaagtcccccaaggaggagctgctgaagatgtggggggaggagctgaccagtgaagcaagtgtctttgaagtctttgttctttacctctcgggagaaccaaaccggaatggtcac

SEQ ID NO: 348662 - DNA, 474 bp, Homo sapiens
agtagtcctgataccttaggtgtctgcgaaagggcgtctggcagggctggggttggtgacaggcacctgtctctcccacaggcctacttagagtttttcacttcccgcgagacagcggaagcacttctgcaagtgctgaagaagtacgagctccgggttaattaccaccttgtcaatgtgaaggtaggccaggccccagggttcccacagagtaccaggcccttcgttgagcaaacacccagcacctagcctgggctaggcattgtgcaagacagagagatacaggcagaactggggccctgctcttaaggagctcccagcctagagtgagggaggcagatcaatgtgtgaccaccagccagtgtaagtgggaaaatcaagttcaggagaggatgctgtcgggtccagaggagggatatctcacctgggaggccagggaaggcttctcagagggtcatctgtgggaatcactga

SEQ ID NO: 348663 - DNA, 5562 bp, Homo sapiens
gggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacagcaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatcaaagaaggattagaaaccgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgcattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgcccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattagcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtattgcaaaagttagaagtcattttacaaattaaaaaaacatttttttcttggtagtctttaaaaattaggggattgaaaggatccaggatgggctttgtgtgtgtgtctcagattctcatttattagtgagcacacctgtgtatatatataaatcacaaggagatcatcaagggaaaacattttgcatgtgtaaagcttcatgaagttctctttaaaaaataccaaagcttgtttatttctgataattaacctaagcccttatgaaaataaacaaaatgaagggattatgacaggtattaccaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgta

SEQ ID NO: 348664 - DNA, 634 bp, Homo sapiens
gggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccaggtaccctttgtacacaagctgccaccaaaggcatggctgtgggccaggagaagcaggcatgctttcttcctaaaagtgctgttacagt

SEQ ID NO: 348665 - DNA, 703 bp, Homo sapiens
acctccacttatagcggctgcataagcttaactgcgcagagctatactgctttttgaaatactaacttgcaagttcagcaacagctaagaaaacaatcctagacttggaaattgaaagattggaagagaagtggagggattcctttggaaccctttacgtacgtatgtgtaaggaattgtaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagaggttgcccacctctgtgtcaatgcagcctgctcttaatgactccagctctctaggctggacgcagtggctcacaccggtaatcccagcactttgggaggctgaagccggtggatcacctgaggtcaggagcttgagaccagcctggccaacatggtgaaactccgtgtcttctaaaaaaatacaaaaattagagcggcatggtggcgggcgcctgtaatcccagctactcgggaggctgaggcaggagaattgcttgaacccaggaggtggaggttgcagtgagccaagatcgtgccactgcattgcagtctgggaaacaag

SEQ ID NO: 348666 - DNA, 249 bp, Homo sapiens
gggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggtagagtgacgcgcgtcccctttgtgtccgcatcgcccgggccggccgcggagcggggagggcgggacgcggcgctgcgcggccggccttggggctcggggcttgcggccg

SEQ ID NO: 348667 - DNA, 5606 bp, Homo sapiens
acctccacttatagcggctgcataagcttaactgcgcagagctatactgctttttgaaatactaacttgcaagttcagcaacagctaagaaaacaatcctagacttggaaattgaaagattggaagagaagtggagggattcctttggaaccctttacgtacgtatgtgtaaggaattgtaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacagcaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatcaaagaaggattagaaaccgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgcattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgcccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattagcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtattgcaaaagttagaagtcattttacaaattaaaaaaacatttttttcttggtagtctttaaaaattaggggattgaaaggatccaggatgggctttgtgtgtgtgtctcagattctcatttattagtgagcacacctgtgtatatatataaatcacaaggagatcatcaagggaaaacattttgcatgtgtaaagcttcatgaagttctctttaaaaaataccaaagcttgtttatttctgataattaacctaagcccttatgaaaataaacaaaatgaagggattatgacaggtattaccaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgta

SEQ ID NO: 348668 - DNA, 5636 bp, Homo sapiens
gttttgcttacttcaggctttaagcagtgcccccaagtaggtaaggtaggtagtgagtaattgcctggtaagtgaggcaccctgagtgaggaatgccaaatacagttgggttctcagcagggagatcatgggcattttgtctgagcaagcttgggttcacattgaggctctgggtactatttgtgtaagttggcaacttcctcctttgctgactcagttttcacatatgaaaaatggaacagtcatacctttcttgtaaaaatgctctaaggcttcagtgaaagactgagagatcagcctcccttgctgcctttcatcttgcttttagaattcttggctcttgtgtttgctgaggttttgtgccgggatctaacccatagccttagctttgtgattgagcatacagtccctggcacagaatgggtaccccataaatagttgttgaatgaataaaacctcaaaacctcaaatgtgttggttgctgtggactacacagtgggtttcttcagcattaaggaggtaaagatgtttatagacacttctctgtttttctttcagtgcctgaaacagtatgttgagctcttgatcaaagaaggattagaaaccgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgcattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgcccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattagcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtattgcaaaagttagaagtcattttacaaattaaaaaaacatttttttcttggtagtctttaaaaattaggggattgaaaggatccaggatgggctttgtgtgtgtgtctcagattctcatttattagtgagcacacctgtgtatatatataaatcacaaggagatcatcaagggaaaacattttgcatgtgtaaagcttcatgaagttctctttaaaaaataccaaagcttgtttatttctgataattaacctaagcccttatgaaaataaacaaaatgaagggattatgacaggtattaccaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgta

SEQ ID NO: 348669 - DNA, 817 bp, Homo sapiens
gggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagacagtctcgctgtgtcgcctaggctggagtgcagtggcatgatctcggctcactgcaaactctgcttcccgggttcacatcattctcctgcctcagcctccccagcagctgggactacaggcgcacactgccacgcccggctaatttttgtatttttagtagagacggggtttcaccatgttagccaggatggtctcgatctcctgaccttgtgatccacctgcctcagcctcccaaagtgctgggattacaggcgtaagccaccgcgcctggccaaatcttttataaaattataccttcaggctatgtgggtataaggtgtatatggagcaaaagtgaatttcatgtttaaacttgggtcctgatatggtttggctttgtgtcctcacccaaatctcatcttgtagctcccataattcccatgtgttgtaggaaggacccagtggaagatgattgaatcatgggggcgggtctttccc

SEQ ID NO: 348670 - DNA, 5416 bp, Homo sapiens
gggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagtgcctgaaacagtatgttgagctcttgatcaaagaaggattagaaaccgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgcattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgcccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattagcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtattgcaaaagttagaagtcattttacaaattaaaaaaacatttttttcttggtagtctttaaaaattaggggattgaaaggatccaggatgggctttgtgtgtgtgtctcagattctcatttattagtgagcacacctgtgtatatatataaatcacaaggagatcatcaagggaaaacattttgcatgtgtaaagcttcatgaagttctctttaaaaaataccaaagcttgtttatttctgataattaacctaagcccttatgaaaataaacaaaatgaagggattatgacaggtattaccaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgta

SEQ ID NO: 348671 - DNA, 5690 bp, Homo sapiens
gttttgcttacttcaggctttaagcagtgcccccaagtaggtaaggtaggtagtgagtaattgcctggtaagtgaggcaccctgagtgaggaatgccaaatacagttgggttctcagcagggagatcatgggcattttgtctgagcaagcttgggttcacattgaggctctgggtactatttgtgtaagttggcaacttcctcctttgctgactcagttttcacatatgaaaaatggaacagtcatacctttcttgtaaaaatgctctaaggcttcagtgaaagactgagagataaaatatttaatgcagtgcctgcatcttataggcatttgagaaatattacctcccagcctcccttgctgcctttcatcttgcttttagaattcttggctcttgtgtttgctgaggttttgtgccgggatctaacccatagccttagctttgtgattgagcatacagtccctggcacagaatgggtaccccataaatagttgttgaatgaataaaacctcaaaacctcaaatgtgttggttgctgtggactacacagtgggtttcttcagcattaaggaggtaaagatgtttatagacacttctctgtttttctttcagtgcctgaaacagtatgttgagctcttgatcaaagaaggattagaaaccgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgcattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgcccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattagcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtattgcaaaagttagaagtcattttacaaattaaaaaaacatttttttcttggtagtctttaaaaattaggggattgaaaggatccaggatgggctttgtgtgtgtgtctcagattctcatttattagtgagcacacctgtgtatatatataaatcacaaggagatcatcaagggaaaacattttgcatgtgtaaagcttcatgaagttctctttaaaaaataccaaagcttgtttatttctgataattaacctaagcccttatgaaaataaacaaaatgaagggattatgacaggtattaccaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgta

SEQ ID NO: 348672 - DNA, 5647 bp, Homo sapiens
gggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacagcaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatcaaagaaggattagaaaccgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgcattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgcccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattagcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtattgcaaaagttagaagtcattttacaaattaaaaaaacatttttttcttggtagtctttaaaaattaggggattgaaaggatccaggatgggctttgtgtgtgtgtctcagattctcatttattagtgagcacacctgtgtatatatataaatcacaaggagatcatcaagggaaaacattttgcatgtgtaaagcttcatgaagttctctttaaaaaataccaaagcttgtttatttctgataattaacctaagcccttatgaaaataaacaaaatgaagggattatgacaggtattaccaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgtattgtgtcttacgtagtttgtccccccctttagcagggattcctttttaaagctattttggctggaatacaggtgacttttgtaaa

SEQ ID NO: 348673 - DNA, 4821 bp, Homo sapiens
gggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacagcaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatcaaagaaggattagaaaccgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgcattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgcccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattagcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgatgaacctggaacatcgtatggacattcggcgtgtgcagggtaccgagct

SEQ ID NO: 348674 - DNA, 2894 bp, Homo sapiens
gatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348675 - DNA, 2740 bp, Homo sapiens
cccgggagaggaggcggcgacgcggaggggcgcgggatcaggggccctgggagggcgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgatgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348676 - DNA, 2006 bp, Homo sapiens
  misc_feature (1503)..(1503): n is a, c, g, or t
ggggagtcagcgagggcgagcctactggagtttgccgggggtgggaagaaggtgggcctcgagcaaagccgctagaggtggggtgcgggtggtcggcctcaggcgagccccggggcacagcccggggcgggaggcggagcttggcggccgagatctccgcgctgcagttagccccgccgagcgccaggagctgcgggtaggaggggcgagagaaaggatgggggtacagaaccggaagaaacgaagggctcgtccgcttcggcttgtcctaatttggtgcccaatctgaagctgggctgtaccattgcatacctgggggaggctgtggcaaaggtgacaagaaggccgaaggcacaaagggaagctgcacccattcctggaggagcttaaatagtgactcgagtgcaagaatttaaaaataccgagacagccctaggtggaaaacttccggaaggcccaagcgttcgtaagggctctctaccccgctcggagcatagatggtaccgtccggaagtccgggcggagaccgtagctgcgcttctcgcgaaagggcaggcatcgcggggctggccacttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaattgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagggcccagctcctaacatgcaggtgtcaccagagagaaatgcaccactgtgcccagcaccatagctctggctcagagngtttgcctgagaaagcagcagacagaaaacagaaggtgcgagttgctcccgaaggaactgacttcatgtgcaacagagctcggagaagtccaaggctaagcacactctccagaacagtggaggttgtgctgaaaggcaactgggaggcgacggagagcctgggaggtgcgggctacactggaggccagcaagtctgccagagagaaacagaaaaaaagacaggtgggaagagctctcctggggtcagaacaaagcttaatatcttctttgacaaagaacgtaacatcaaaatagccaactatgggtttagttcaacatttgcaaagagagacaacactgaaaagggaacgtttgatgggactctcccttatgcaggcccagaactcttcttgggccatggataccaatgccctgccatcaacgtttggagccttggcatcatcgtatgcaaaatggtggctggggccctgccattttatgagcagaactgtaaggatatactg

SEQ ID NO: 348677 - DNA, 772 bp, Homo sapiens
ctcagcctcccgagtggctgggactacaggcgcccgccatcacgcctggctagttttttgtatttttagtagagacggggtttcactgtgttggccgggatggtctcgatctcctgacctcatgatccatccacctcagcctcccaaagtgctgggattacaggcgtcagccaccgtgaccagcctgaaacaggagcaagttctaaactcaggctctagagtcagaaaagtgtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348678 - DNA, 813 bp, Homo sapiens
gatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348679 - DNA, 519 bp, Homo sapiens
ttggtctggcccatattgtgtatctgctaccctggtgacctaagcatgtcacacagatatcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaaccacaaatatcgtttttttctggcaaaatgagacaaacttcctttaaatttgggcataaacaggtgatgaatgaaaatgcaaggcgggtcatgatcatatttaatagcctacagtaaatacacggaaaggtggggtcagtgcccggagaggagaaaggtggagccagaaccacaaatatcg

SEQ ID NO: 348680 - DNA, 776 bp, Homo sapiens
cctttcccatttgtgtagtctgggcaggttaggatttccggggtggcttgaaggtggggccggaggcttgggagggacctatggatatctgcagggagggcgtgaccaaggctgcctggatgacggcgggggatggtggaatatatctccccctgccctctccacctgcatgtcccaggtccagccctgcccaagttctatcatttccccacagcgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaagtgagcccctctgctcgcctcccacgagctccctgcctagttggggagctggcaagcaaacaggcgattacagtgcaggggactcgcgcagcagcgctaggctccacacacagactgcaggcaggcaggccctcatcctgccagctgtccttgcatccaacagattttt

SEQ ID NO: 348681 - DNA, 533 bp, Homo sapiens
ggggagtcagcgagggcgagcctactggagtttgccgggggtgggaagaaggtgggcctcgagcaaagccgctagaggtggggtgcgggtggtcggcctcaggcgagccccggggcacagcccggggcgggaggcggagcttggcggccgagatctccgcgctgcagttagccccgccgagcgccaggagctgcggactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaagttcatgcgcttcatgatgatgcgagcagagaacttctttatccttcgaaggaagcctgtggaggtgagaccct

SEQ ID NO: 348682 - DNA, 1676 bp, Homo sapiens
gtgtttccatgaataccttccacaagggacacaggcttgaccttaggggctgatatggagccccactcctggtgtactggttgggctcaatttcttgggcaacagagggtataagctagggctatttgataaaggggaaaagtgcctgatggttgttataaagtggaagaataatggggtagagaatgggtttgagttcacgggctttttttcccctattaatagacaagtgtgtttttttttttttcttctgtgttcgtccgcagtggccaagttgaatgatgctgcccggggctctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348683 - DNA, 1504 bp, Homo sapiens
ctaagcgttttgagctgcattgctgcgtgcttgatgcttgtcccttttgatcgtggtgatttagagggtgaactcactggaacggggatgcttgcatgtgtaatcttactaagagctaatagaaaggccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348684 - DNA, 1457 bp, Homo sapiens
tacagcgcttataaagtcaggaggcaaagacaggcttatagctgatgtactcagtatgagctaacattatggtatggctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348685 - DNA, 1817 bp, Homo sapiens
gtgtttccatgaataccttccacaagggacacaggcttgaccttaggggctgatatggagccccactcctggtgtactggttgggctcaatttcttgggcaacagagggtataagctagggctatttgataaaggggaaaagtgcctgatggttgttataaagtggaagaataatggggtagagaatgggtttgagttcacgggctttttttcccctattaatagacaagtgtgtttttttttttttcttctgtgttcgtccgcagtggccaagttgaatgatgctgcccggggctctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgccagcagtccctctgctgacccagcgaggctctggggaagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348686 - DNA, 1490 bp, Homo sapiens
gtgtttccatgaataccttccacaagggacacaggcttgaccttaggggctgatatggagccccactcctggtgtactggttgggctcaatttcttgggcaacagagggtataagctagggctatttgataaaggggaaaagtgcctgatggttgttataaagtggaagaataatggggtagagaatgggtttgagttcacgggctttttttcccctattaatagacaagtgtgtttttttttttttcttctgtgttcgtccgcagtggccaagttgaatgatgctgcccggggctctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348687 - DNA, 1263 bp, Homo sapiens
gtgtttccatgaataccttccacaagggacacaggcttgaccttaggggctgatatggagccccactcctggtgtactggttgggctcaatttcttgggcaacagagggtataagctagggctatttgataaaggggaaaagtgcctgatggttgttataaagtggaagaataatggggtagagaatgggtttgagttcacgggctttttttcccctattaatagacaagtgtgtttttttttttttcttctgtgttcgtccgcagtggccaagttgaatgatgctgcccggggctctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348688 - DNA, 1532 bp, Homo sapiens
  misc_feature (1029)..(1029): n is a, c, g, or t
gtgtttccatgaataccttccacaagggacacaggcttgaccttaggggctgatatggagccccactcctggtgtactggttgggctcaatttcttgggcaacagagggtataagctagggctatttgataaaggggaaaagtgcctgatggttgttataaagtggaagaataatggggtagagaatgggtttgagttcacgggctttttttcccctattaatagacaagtgtgtttttttttttttcttctgtgttcgtccgcagtggccaagttgaatgatgctgcccggggctctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagggcccagctcctaacatgcaggtgtcaccagagagaaatgcaccactgtgcccagcaccatagctctggctcagagngtttgcctgagaaagcagcagacagaaaacagaaggtgcgagttgctcccgaaggaactgacttcatgtgcaacagagctcggagaagtccaaggctaagcacactctccagaacagtggaggttgtgctgaaaggcaactgggaggcgacggagagcctgggaggtgcgggctacactggaggccagcaagtctgccagagagaaacagaaaaaaagacaggtgggaagagctctcctggggtcagaacaaagcttaatatcttctttgacaaagaacgtaacatcaaaatagccaactatgggtttagttcaacatttgcaaagagagacaacactgaaaagggaacgtttgatgggactctcccttatgcaggcccagaactcttcttgggccatggataccaatgccctgccatcaacgtttggagccttggcatcatcgtatgcaaaatggtggctggggccctgccattttatgagcagaactgtaaggatatactg

SEQ ID NO: 348689 - DNA, 1184 bp, Homo sapiens
gtgtttccatgaataccttccacaagggacacaggcttgaccttaggggctgatatggagccccactcctggtgtactggttgggctcaatttcttgggcaacagagggtataagctagggctatttgataaaggggaaaagtgcctgatggttgttataaagtggaagaataatggggtagagaatgggtttgagttcacgggctttttttcccctattaatagacaagtgtgtttttttttttttcttctgtgttcgtccgcagtggccaagttgaatgatgctgcccggggctctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcaggtgaggaggttgggcccaggcaggaccccagagagtctgcaccctcttccaggcagccctgcagtggagcataggactctgcagtcagacccagtttaagacccagattcaagtcctggtcctgctaaggtgacctcacttccttgagcctcagtttcctgatctttgaaatggggatattattaccatctttctcatgggaatgggagaataaaatgaattcatgtatgag

SEQ ID NO: 348690 - DNA, 2416 bp, Homo sapiens
ttgctattgtcattattaccatgcatatttatttctctacttatttatagtctgtttatttctcctaatggaatataaaaatttcctgatggcagagtccataactgtctggttcacctttatatcccctatgtctggcacttatgcaatacttattgaagaagtatccttctctcacattgcagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348691 - DNA, 2189 bp, Homo sapiens
ctcagcctcccgagtggctgggactacaggcgcccgccatcacgcctggctagttttttgtatttttagtagagacggggtttcactgtgttggccgggatggtctcgatctcctgacctcatgatccatccacctcagcctcccaaagtgctgggattacaggcgtcagccaccgtgaccagcctgaaacaggagcaagttctaaactcaggctctagagtcagaaaagtgtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348692 - DNA, 2189 bp, Homo sapiens
cccgggagaggaggcggcgacgcggaggggcgcgggatcaggggccctgggagggcgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgatgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgcgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348693 - DNA, 1469 bp, Homo sapiens
tgggagaatggaatagcaggtagatagatgggtaggtggatctgtggaaggataggtaggcagggagtggatagatggatggggactgaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348694 - DNA, 1075 bp, Homo sapiens
cctggagctctgtgactctaggtactgactcagaggtgggctttccatttctcagctcagaaacgcctctttgaccaggtgcctcagaaagtaattccacccatctctactctgggtcccgctgggccaaggattccagtaccactgactgagtgggccttgtctcctcttcttgcccacagcctgctgtggaggtgcctcaatatgtgggcatccggctcctggtagagggcttcaccatcaagaagcccatggcgatgtgtcatcggcggatgggggtccgccagcagtccctctgctgacccagcgaggctctggggaaggcaaggactcggggacccctacccacagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348695 - DNA, 1644 bp, Homo sapiens
gatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccagtgagtcccctgcagctgggactttgggctgtgggcaggtgcttagggatagaccctttctgtctcgtgcagcccctaccccttccccaagcctcccgctcgtttaccccgctgttctgctcaggaaccctcgaggactcccactgcctccgtgatagggtctgggccacttttcttggttcttggcatagcatagtcactaagagcatggactgtgccaccaaatggacagcacattacccaaagtgtgtgttgtgtggatgttaattctacaggaagtaaatagattttatgaaaaaaaaaa

SEQ ID NO: 348696 - DNA, 1800 bp, Homo sapiens
gatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatggaaaccaaagcggagatgctgtccgcttacaaaacttaactatagggttagggccccaggttctgggttgacaaatatcaagacgttgcagcatctccgctttggaaa

SEQ ID NO: 348697 - DNA, 999 bp, Homo sapiens
ttgctattgtcattattaccatgcatatttatttctctacttatttatagtctgtttatttctcctaatggaatataaaaatttcctgatggcagagtccataactgtctggttcacctttatatcccctatgtctggcacttatgcaatacttattgaagaagtatccttctctcacattgcagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcatagaggacttctggctgactgctgcccgcaacgttctcaagctggtggtgaagtctgagtggaagtcataccctattcaggcagtagaggaagaggcctcaggtaagtactgtggttacctccactctcccacccatttatcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348698 - DNA, 1408 bp, Homo sapiens
gatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacccctgcttcgattccccactgcccttgtcctggatccaacaccaaataaaaagaaacaagtgaagta

SEQ ID NO: 348699 - DNA, 867 bp, Homo sapiens
ctcagcctcccgagtggctgggactacaggcgcccgccatcacgcctggctagttttttgtatttttagtagagacggggtttcactgtgttggccgggatggtctcgatctcctgacctcatgatccatccacctcagcctcccaaagtgctgggattacaggcgtcagccaccgtgaccagcctgaaacaggagcaagttctaaactcaggctctagagtcagaaaagtgtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcttcattcatctacctgatgtcagctccatactccccatccatctatccactccctgcctacctatccttccacagatccacctacccatctatctacctgctattccattctcccatctactacctatctgttcttcaggccatccactcatc

SEQ ID NO: 348700 - DNA, 781 bp, Homo sapiens
ctcagcctcccgagtggctgggactacaggcgcccgccatcacgcctggctagttttttgtatttttagtagagacggggtttcactgtgttggccgggatggtctcgatctcctgacctcatgatccatccacctcagcctcccaaagtgctgggattacaggcgtcagccaccgtgaccagcctgaaacaggagcaagttctaaactcaggctctagagtcagaaaagtgtagagtcaggttctggatccaaaatggggcaagtcatgatcaggttctggaaccagaacaggcctcaagcctaggggctgagcagggtatcccctggcctgggagcagaggacttctggctgactgctgcccgcaacgttctcaagctggtggtgaagtctgagtggaagtcataccctattcaggcagtagaggaagaggcctcaggtaagtactgtggttacctccactctcccacccatttatcctccacccatccgcccttccacctatctgcccttctacctatctattcatccacgcacctactggttcatccacacatctgtgtatgattcacatctacccatctatccatccatccaccagccatccatccactcatccacccacgtattcacccactctctgatctaccgattcacccacccacccttccactcatccttccatcctcccacctgtcacccattgttaatctcttcattcatctacctgatgtcagctccatactccagcctgggtgacagatcaaggatctgtctcaaa

SEQ ID NO: 348701 - DNA, 1243 bp, Homo sapiens
ttgctattgtcattattaccatgcatatttatttctctacttatttatagtctgtttatttctcctaatggaatataaaaatttcctgatggcagagtccataactgtctggttcacctttatatcccctatgtctggcacttatgcaatacttattgaagaagtatccttctctcacattgcagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgaggccctgggggccaagatgatacagggactgcctgcttagagggagggcattggtgtccagctgggtgacctcagacaagtcctttctttctctgggccacagtttccctatctgtagtaaaaactgcttctttaaaggctggatagagctggacatggtggctcatgcctgtggtcccagctactcaggaggccaaggtgggaggataacttgaggctaggagttcaagaccagcctgggcaacatagtgagactcagtctctacaaaaaaaggtagaaaaacattatccgggtgtggtggcatgtacctgtagtcccagctactcgggaggctaaggtgggaggatcacttgaacctgggaattacaggctgcagtgagctatgatcgcaccattgcactccaacctgggcagcaaagcaagactctatctctaaaaaagaaataagtgaataaaggctagataggcccacagagtggggagggacacagcagggctgtgtcccatctggcctgggattcagagctctgctaggtcataccagatgccagcacagccgccatgcatggtaactcccccttcaaataaaaaccccatagttccccttccccgctgcccttggtaagtgaaggcaggaaggaaggtcttaaaaagctctggaagagacggagcggggtggcttatacctgtaatcccagcactttttgggaggccgaggcgggcagattccttgaggtcaggagttcgagaccagcctggccaacgtggtgaaaacccatctctact

SEQ ID NO: 348702 - DNA, 903 bp, Homo sapiens
ttgctattgtcattattaccatgcatatttatttctctacttatttatagtctgtttatttctcctaatggaatataaaaatttcctgatggcagagtccataactgtctggttcacctttatatcccctatgtctggcacttatgcaatacttattgaagaagtatccttctctcacattgcagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgggtctatgtctcaatctccggaatttgccgtggtttgatgaggttgatgccaactccttcttcccacgctgctactgcctgggggctgaggatgacaaaaaagccttcataggtaaggagacccccagccctatgcctgaacctcaggctgacagagcagggctgaagctctggctcatattggagagaaacaggcctctcttcatgccctcatctgcctgccccagcagatttccctttccaccctcaatccttatccttccctaatgtgccctcccttaataagcctcttagcttggtcaactctgacctccagaaaagcttgggtagcttggcttatattctagagcaggttctaaaagttggtcagtcccttgagtttggaatccagaacagattccaggcttatatcaagttccatttgttgaattgggttccaaaaaaggct

SEQ ID NO: 348703 - DNA, 474 bp, Homo sapiens
tcggatacccaccccctcggccccccgcacaccccggtcctcgatgacccctctccgcaggatggtgaggcccgtgcggcccgctcgctctggcctacagcggctgcgaggacgacaagacgctggggtggagggactgggggtcgggagaagagcggctgagggtgggcatctggatgaaggcaggaggaagaaaagaggcgtggctatgggcggccagaaaagatcctaggccgagaccctaggcccagcctcagtgtaccccgcccctattccgcatctttctgcaggtttcccggtcctctggcgaggatcctccaaggcgtctcacatgaaccggctcagaaacgccaaaatctacgtggagagagctgtcaaggtcagaggaggggcaggggcgcttagaaagggccctgggagcggctcagcctgtctccctgcgctgttttcttatatccttaaaaaacaaaagca

SEQ ID NO: 348704 - DNA, 483 bp, Homo sapiens
ctaattccatgagaaaggtctatggcaagggatacaatgttgagcgggtacagacaaaagggcggcttccaagacggcaggcaaacacacaggatgagagggtctccaaaaaaacccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348705 - DNA, 505 bp, Homo sapiens
tccaaggatcagatgataaaccactacgcccgggctggctcctttaccacaaaggtgggtctatgtctcaatctccggaatttgccgtggtttgatgaggttgatgccaactccttcttcccacgctgctactgcctgggggctgaggatgacaaaaaagccttcataggtaaggagacccccagccctatgcctgaacctcaggctgacagagcagggctgaagctctggctcatattggagagaaacaggcctctcttcatgccctcatctgcctgccccagcagatttccctttccaccctcaatccttatccttccctaatgtgccctcccttaataagcctcttagcttggtcaactctgacctccagaaaagcttgggtagcttggcttatattctagagcaggttctaaaagttggtcagtcccttgagtttggaatccagaacagattccaggcttatatcaagttccatttgttgaattgggttccaaaaaaggct

SEQ ID NO: 348706 - DNA, 1532 bp, Homo sapiens
gcagctccgtaccccgatatttgtggttctggctacggatctggggaggggggaaatgccatcaaggatcacagttcttcatcacgggaaccctgggaatcggtgtcccggcttacacctgatacaggctccgagtctaaggtggggaaggaaggccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348707 - DNA, 1845 bp, Homo sapiens
gtgtttccatgaataccttccacaagggacacaggcttgaccttaggggctgatatggagccccactcctggtgtactggttgggctcaatttcttgggcaacagagggtataagctagggctatttgataaaggggaaaagtgcctgatggttgttataaagtggaagaataatggggtagagaatgggtttgagttcacgggctttttttcccctattaatagacaagtgtgtttttttttttttcttctgtgttcgtccgcagtggccaagttgaatgatgctgcccggggctctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcctgctgtggaggtgcctcaatatgtgggcatccggctcctggtagagggcttcaccatcaagaagcccatggcgatgtgtcatcggcggatgggggtccgccagcagtccctctgctgacccagcgaggctctggggaaggcaaggactcggggacccctacccacagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348708 - DNA, 2579 bp, Homo sapiens
gtgtttccatgaataccttccacaagggacacaggcttgaccttaggggctgatatggagccccactcctggtgtactggttgggctcaatttcttgggcaacagagggtataagctagggctatttgataaaggggaaaagtgcctgatggttgttataaagtggaagaataatggggtagagaatgggtttgagttcacgggctttttttcccctattaatagacaagtgtgtttttttttttttcttctgtgttcgtccgcagtggccaagttgaatgatgctgcccggggctctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagtatttggggcttgactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaggaggcatggcttacccaagatcacgtggcagtgagtcgacgcagggacatattgccagaactgccgagcactgggagccccccaaccccagagaacaagccaagctagcagaatgacacctaccgggcataggaacgttaatgccatgagacaagggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtagtgggttgaactgtggtcccctgaaaagagatgtctacttggaccctgtgaatgtgaccttatgtgggaaaagagtctttgtagctgggtatggtggctcacacctgttatcccagcactttgagaggccaaggggcaggagatcgcttgagcccacaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacagagtgaaaccctaaatcaaaaa

SEQ ID NO: 348709 - DNA, 1474 bp, Homo sapiens
gtgtttccatgaataccttccacaagggacacaggcttgaccttaggggctgatatggagccccactcctggtgtactggttgggctcaatttcttgggcaacagagggtataagctagggctatttgataaaggggaaaagtgcctgatggttgttataaagtggaagaataatggggtagagaatgggtttgagttcacgggctttttttcccctattaatagacaagtgtgtttttttttttttcttctgtgttcgtccgcagtggccaagttgaatgatgctgcccggggctctgccagaaccacaaatatcgcgatatttgtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggatccaggacaagggcagtggggaatcgaagcaggggcttccctagcttcatatcccccaggcccctgcgcctctggaatgtaccaacaagggtcgacg

SEQ ID NO: 348710 - DNA, 1554 bp, Homo sapiens
agcacacaggttagatgacttccctaaggtctcacaactagtgtggagatggcgcttgaacacgtcctggcgatgacggggccatacccttacccaccctcttatcttccagacactgggatggttaactgagactatgcacaaagcacttactactgcggcccccgtaactagcgccctcagagcagccctgagagataagagtggttctggccctagaagaatgtggtggggcccaggcctctgtcctttttgtccttcccagtagggccccatctcaagttgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348711 - DNA, 2375 bp, Homo sapiens
cccgggagaggaggcggcgacgcggaggggcgcgggatcaggggccctgggagggcgagcgcggcgaggggcgcatgcagggccccgacgcgccactgctcctgagcgcgagggagctggggcccgggcgccggggctcggcctcctggtaccgccaggagggcggcgcggtgtgcaactggctgcggaagccgcagccgctcgagccacgcaccagtttcccctcggcgcgccgctccgagttccgtccacccaggaggctgccatgggccggccctgcctccgcccagtccgaggagggtcacgcaggcggcagatgccaggcgggcagccccgcccctgcgcgccgcctcagcggcgccttcaagacgctggtcccaggcacccacgcccagggcgcctcggatacccaccccctcggccccccgcacaccccggtcctcgatgacccctctccgcaggatggtttcccggtcctctggcgaggatcctccaaggcgtctcacatgaaccggctcagaaacgccaaaatctacgtggagagagctgtcaagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatgcgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348712 - DNA, 2150 bp, Homo sapiens
ggggagtcagcgagggcgagcctactggagtttgccgggggtgggaagaaggtgggcctcgagcaaagccgctagaggtggggtgcgggtggtcggcctcaggcgagccccggggcacagcccggggcgggaggcggagcttggcggccgagatctccgcgctgcagttagccccgccgagcgccaggagctgcgggtaggaggggcgagagaaaggatgggggtacagaaccggaagaaacgaagggctcgtccgcttcggcttgtcctaatttggtgcccaatctgaagctgggctgtaccattgcatacctgggggaggctgtggcaaaggtgacaagaaggccgaaggcacaaagggaagctgcacccattcctggaggagcttaaatagtgactcgagtgcaagaatttaaaaataccgagacagccctaggtggaaaacttccggaaggcccaagcgttcgtaagggctctctaccccgctcggagcatagatggtaccgtccggaagtccgggcggagaccgtagctgcgcttctcgcgaaagggcaggcatcgcggggctggccacttccgtacttccgctttccggcccagccagcgcccgcgatgactgccactctccgcccctacctgagtgccgtgcgggccacattgcaggctgccctctgcctggagaacttctcctcccaggttgtggaacgacacaacaagccggaagtggaagtcaggagtagcaaagagctcctgttacaacctgtgaccatcagcaggaatgagaaggaaaaggttctgattgagggctccatcaactctgtccgggtcagcattgctgtgaaacaggctgatgagatcgagaagattttgtgccacaattgaatagtgcagggtggcccagggctgcttccaggacttgcctgtcctccctgagtttggatgggagagacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348713 - DNA, 1301 bp, Homo sapiens
aaataagccacgaaccacaaatatcgaggtgatccgtctgacaatcgacttgcacgacgagtctatgcttgtcattgctcatctgtggaatgaagagacacacaagggcctggacctcagttttctgttctctgccccagctcagtgcacctgtgcaacaactccatccagaagcacctggagaactcatgccatcggcatccactgcttccgccagaaccacatgtggtctagccagaggttccaggcccacctgcaggagatgggtgccccaaatgcttggtccaccatcatcgtgcctggcatgaaggatgctgtgatccacgcacttcagacctcccaggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggatgctggaccgcaactgtgacacaggagcctttgagctcatctataagcagcccgtcaccacttccccagcctccacaccaaggcccagctgccttctccccatgtactccgacaccagggccaggtcctcagacgacagcacagcaagctggtgggcactaaggccctgtcgaccacaggcaaggccttgaggactctacccacggctaaggtcttcatttccctcccaccgaaccttgatttcaaggtggcacccagcatcctgaagccaagaaaggtgggcctcgacctgtgactcacacccagtggacagtgctgagcacggggtcagggctggagggcacaggcagagggcagctcccaggctggctggcaccccaagggaagagctggtctccctcagaagccccttcctccacagacttctgatcatctccctcttctcccctcctttcacaccgaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348714 - DNA, 1233 bp, Homo sapiens
gatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcactaaggccctgtcgaccacaggcaaggccttgaggactctacccacggctaaggtcttcatttccctcccaccgaaccttgatttcaaggtggcacccagcatcctgaagccaagaaaggctcctgctctcctgtgcctccgaggcccccagctggaagtgccttgttgcctctgccctttgaagtcggaacaattcctagcacctgtcggaaggtcaaggccaaaggcaaattcaaggccagactgtgacaaacccagggctgaggcctgccccatgaagaggctgagccccctgaaacccctgccccttgttggtacattccagaggcgcaggggcctgggggatatgaagctagggaagcccctgcttcgattccccactgcccttgtcctggatccaacaccaaataaaaagaaacaagtgaagta

SEQ ID NO: 348715 - DNA, 1868 bp, Homo sapiens
gatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaagtttgacctcagacagtggttcctggtaactgactggaacccacttaccgtgtggttctaccgcgacagctatattgttatacgccggccaatcgctatcctacgccgatgaagaaacacgacagctctggcaaccagtgcaaccaatccagccagagacgacacatggagaatcacaccaccgcaatcacgcgcttacgtccatgacacacagcggtaaagccaggcgtacagcccacccgcaggatcagt

SEQ ID NO: 348716 - DNA, 1506 bp, Homo sapiens
gatccactcctcattcagccctcccatgggcctggcatgtagccgagcaccctggagagggcagactaagaagacatggtccgtccctgcctgtgaggagttcaggtctctgaggaggaggaagcagtgaaactgggctttacacatggcctgagaacagcttaggcctgaacataaggaacagcttggagtggaggggacacagaggaaccctcactatcatgcatgccaacccaaccactgcctgccctttcccttctggatttagctcgtgtctccaggctcctagtcctgtaatccagggacccatcagcgagggattcagggaagcagaggcagctctccaggaaggaggaaaatccctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctaggttcgtgctgggcctcaggtaagtgacaggccttaggacaatgggggctgtggcatgcgtcaggttacctgccttgatatgggatcgtgacaggcccctccctatgtgcaggagacaagcagcccaagaaacaggagaaaaacccagtgttggtgtccccagagtttgtggatgaagctctgtgtgcgtgcgaggagtaccttagcaacttggcccacatggacatcgacaaggacctggaggccccgctgtacctcacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcctggagaacatctcgctgtcggtgaagaagttgcagagctattttgctgcatgtgaggatga

SEQ ID NO: 348717 - DNA, 959 bp, Homo sapiens
ttgctattgtcattattaccatgcatatttatttctctacttatttatagtctgtttatttctcctaatggaatataaaaatttcctgatggcagagtccataactgtctggttcacctttatatcccctatgtctggcacttatgcaatacttattgaagaagtatccttctctcacattgcagcagaagaagatctttacaatccaaggctgctacccggtgatccggtgtctcttgcgccggaggggctgggtggagaagaagatggtccatcgctcaggccccaccctgctgccaccccagaaggatctggatagctcagcgatgggtgacagtgacaccactgaggatgaggatgaagatgaggacgaggagttccagccatcacagctgttcgacttcgatgatttactgaaatttgatgacctagatggaacacatgctctgatggtgaggccctgggggccaagatgatacagggactgcctgcttagagggagggcattggtgtccagctgggtgacctcagacaagtcctttctttctctgggccacagtttccctatctgtagtaaaaactgcttctttaaaggctggatagagctggacatggtggctcatgcctgtggtcccagctactcaggaggccaaggtgggaggataacttgaggctaggagttcaagaccagcctggctcactgcaacctccacctcccgggttcaagcgattctcctgcctcagcctcccaagtagctgggattacaggtatgcaccaccatagccagctaatttttgtatttttagtagagacggggttttgccatgattgtaaatttcctgatgtctccccagccatattgaactgtgagtcaattaaacctcttcccttaataaattacccagtctcaggtatgtctcaataaagagcatgtgaaattagaaatgatttgccctga

SEQ ID NO: 348718 - DNA, 471 bp, Homo sapiens
aggctggcttgctctctgcccacctgtgccctggaggaagagaaatcttcttgacttacacaaagatgatgtgtgggctagaggccaccttggaagcatcctctccttcctgttcacccaccctgctcagcagggcagggagaggctgccttaggccctgctacccacactggcctctgtgtttctgtctcctcctgtctccccagtcccgcatggtccagaatgagatcccctacttcatctggaccactcggcgggatgtgctcgactgtcgcttcctctccaaggatcagatgataaaccactacgcccgggctggctcctttaccacaaaggtgggctccctagaggagcaggcagggcagcttccgaccccctgcccttgggctggcagctctcctccctgctcaccttgttagtaagaggaagttctcaggacaaggggaagtatacaattcagaaaatttggag

SEQ ID NO: 348719 - DNA, 445 bp, Homo sapiens
acaatccttcatcatcaaacagagacagttgccaaagatacagtgttttccttttcattctatcttttgaggagaggggcccctctgtgtaacctgtgaagactagtttccttgacgatgctgctcccttcctctctaatccatccctttcccccttacgccaaccctcctgatgaaccttttccccagaggagtctctttggggaccagggtatgcctcccatgcatgttgtcttctaacagcttgtgttgactcctaactaagctggctgatttcattacaaccagctcacaccttggttgcagtgatttctgtggccttatttatataaccatatatctcatcactctttatattgtgtatttaagtaccactccttttttaaaactaaaaatctaacagcatttattctccagaagaccaaccaacttgttcatttccatt

SEQ ID NO: 348720 - DNA, 196 bp, Homo sapiens
gaaaatcgtaaatccagaatcctctgatgaacatttcctttgagtgtcatgttggcactcaaaaagttttagattttttagcatcttggatttcagatttttggatttaagatgctcaatttatactactactgataataaattcactaacagttattgagtgttcactataaacttcacatcaaacctgtactct

SEQ ID NO: 348721 - DNA, 406 bp, Homo sapiens
ttattttttgtttgtgtattttaaattctaactttaacgtgaccctgagaggcattaggattttaaaaagcgagtgagaaggacccatgaattcactcttgatgatttggcttttgtttcttttgacctgtctccactgccaggtgaaatcaagctaacagaatcatttcaatagttcccttcttgttaaatgtttttaatttctcaatctagagctgaagaaattgattttccatttattccttccttttttcctcttttgttagttgtagtgcgtatcattgctactgtatacaaaatatacatgtatttaaaacacaccaaatcctccctaaaagataaaattcttgttttaagtttttttttgtttgtttgtctgttttaagacagggtctcgttttgttgc

SEQ ID NO: 348722 - DNA, 919 bp, Homo sapiens
ctgacatcagagaccctgggcggggttgaggttctcttgcatatcttttttgacaaaagacaaacaattccttctcaaattgcactgcaaagaataagaaaatataatccccttggatttattctctgctttcagtctaaaggagaaaaagctccccaggattcctaaataacagagaagtttgtagtgtaggaagaatctagaagttgggatggagagaaatgtgggaaagtcttacttttaaagagacattccctaaagaggggtaagaagttctgaaacagtgacgtaccagtgaccatgaatgtttcagagaaggtcagatttgcagtgtgtgtcttagagaaaggctaaatctcaacccagaggaagcatgtcttctgtctcaagccccctgcatgctgtttgtcttgcagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348723 - DNA, 962 bp, Homo sapiens
  misc_feature (505)..(505): n is a, c, g, or t
aaggagaggggaagttgagcttctgttcagctgaggaggatggatacctgctggggcctggtgctgaagttctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaaaaacacaanaacaaaaaaaaaaaaaaaaaaaaaaaaagaaaaaaaatcaaaaaaaaaaaaaaaaaaaaaaaaaaaaaaaaaaaagaaggggggggggggcgaaaaaaaaccccccgggggggggggcacaaaaagtagagcccccccggactttgtctaaggaaagaggggcccacaaaaaggacgagggcacaaaactaaacagacgacgcagccgccggccgatcataaacaaacgacgaggcgcagaagagaaaaatactcagacgagtgagatacactagaggacaagaaacccacccgccagaggaggagagcaaacatagagggaccgaccccaccccaaagaaagtagacccccagagagacgaaaaaaagacgaggggttacacgcggccaccaccagaacaaactcaagaggcgggaagaaacaaactgccgcccggcgatgtacagaaactaccag

SEQ ID NO: 348724 - DNA, 1750 bp, Homo sapiens
gggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348725 - DNA, 1805 bp, Homo sapiens
gggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggagtaagaagtcttaattgccctctcctgcttcagtcgagagccctgtagtccttgtctccttgacatagtgctggtttctgtctataggtttatgggctattactttcattttcgtgttgccagcggagcagtgccctggtacttgctgtcatagctctatatatgtccctttacagtcccctgaggagaactttcttaaattgaaaccttagaggaatgaaggttttcctagatacaaaatggaatttcaggagcacagtaaatttcagggtctgtctatcttaagctttctttatatcagtggaaatccagcgagatattagaaataaaggccagaaaaaattaattaaccatgatggatgaatctatgttattggactaatttgcttcaagaaacaccagaattttgaaaatcccgaatttttgacagcccctcaggcctggagagttatctacagatgttaggatatgtccacataagaaagcatctaaactgaactgagagcacagcgggctaccctggacaaagtaaaggtggaaactaggtgatgtggcctttgagtatgcagattcctggtatcacttgctcgctactttctagggtcttaatagtagtcaagaaaagggatctgagaaaagtactctttcaggagggactagaaagagaagggggtgatatgttacacaaattaaagaaggatgtcttaggcatttagtaaaaattcagtggttccccgctatcctcgggggatgtgtttttttgttttgttttgttttgtttttttttgagatgaagtttcattctatcgcccaggctggagtgcaatggcacaattttggctcactgcaacctccacctcccaggttcaagctattctcctgcctcagcctcctgagtagctgggactacaggtgtgcgccaccatgcccgactaatttttgtattttgagtagagatgggagtttcaccatgttggccaggctggtctcgaactcctgacctggtgatttgcccgccttggcctcccaaagtgctgggattacaggcgtgagtcaccacacctggcccatggtgggggatatgttttaagacccccagttaatgcctgaaaccgctgctagtaccaaaccctaatgttttttcctgtatgtacgtacatatgataaagttcagtttataagttaggcacagtaagagactaacaacagctcacagccaaatagagcaattataacaatatattgtaataaaaattatgtggatgtg

SEQ ID NO: 348726 - DNA, 1663 bp, Homo sapiens
gggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348727 - DNA, 1228 bp, Homo sapiens
  misc_feature (6)..(6): n is a, c, g, or t
tgctcngaggactgttgacatccaagcttcctttgtttttttttcctgtccttctctcacctcctaaagtagacttcatttttcctaacaggattagacagtcaaggagtggcttactaccaaacatcgaggctctgaatggcaactgctctgacactgacatccatgagaaagaagaggaagagttcaatgagaagagtgaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348728 - DNA, 1494 bp, Homo sapiens
gggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348729 - DNA, 2216 bp, Homo sapiens
  misc_feature (1759)..(1759): n is a, c, g, or t
gggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaaaaacacaanaacaaaaaaaaaaaaaaaaaaaaaaaaagaaaaaaaatcaaaaaaaaaaaaaaaaaaaaaaaaaaaaaaaaaaaagaaggggggggggggcgaaaaaaaaccccccgggggggggggcacaaaaagtagagcccccccggactttgtctaaggaaagaggggcccacaaaaaggacgagggcacaaaactaaacagacgacgcagccgccggccgatcataaacaaacgacgaggcgcagaagagaaaaatactcagacgagtgagatacactagaggacaagaaacccacccgccagaggaggagagcaaacatagagggaccgaccccaccccaaagaaagtagacccccagagagacgaaaaaaagacgaggggttacacgcggccaccaccagaacaaactcaagaggcgggaagaaacaaactgccgcccggcgatgtacagaaactaccag

SEQ ID NO: 348730 - DNA, 1687 bp, Homo sapiens
gggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacaggtacgcgtagtctccctgctccaagctctcttcctagactcctgcagcttggcctccccagcaacgcagggggacagtgactcaccagaattatcccagcatttatttagggggttaggggtcctaacacttttttctcctcttaaggaggaacagagaatatctttttaaaaggcaaactttttttttttttttttttttgagctctagtgttctaggacatgggcaagacttaaaactcaacactgcttgtaggtctaagaattaagttgttttaaggatgaaatgcattaagagggagtccatttgatgatagatcccatcctagagtttagttaactttccaccacactggatcacctgccaagccattcccactaagactgcctctgcagcttcccagctctggttggaacccatgctgtggctttttgttggct

SEQ ID NO: 348731 - DNA, 821 bp, Homo sapiens
ctgacatcagagaccctgggcggggttgaggttctcttgcatatcttttttgacaaaagacaaacaattccttctcaaattgcactgcaaagaataagaaaatataatccccttggatttattctctgctttcagtctaaaggagaaaaagctccccaggattcctaaataacagagaagtttgtagtgtaggaagaatctagaagttgggatggagagaaatgtgggaaagtcttacttttaaagagacattccctaaagaggggtaagaagttctgaaacagtgacgtaccagtgaccatgaatgtttcagagaagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348732 - DNA, 496 bp, Homo sapiens
aaggagaggggaagttgagcttctgttcagctgaggaggatggatacctgctggggcctggtgctgaagttctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348733 - DNA, 797 bp, Homo sapiens
  misc_feature (729)..(730): n is a, c, g, or t
gggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcagattnnggtgattgaggaaatgatgcagaactccccagttctggtttagctgttagagctatccactatcctg

SEQ ID NO: 348734 - DNA, 1701 bp, Homo sapiens
cgggagagcgattgttttactacagacgggcgggagaagggaccggggcggctgcgcggtggcggggcgcgctgccgtcgggtgggccccgggctctggaatgcggggagcagtgtttgacggcgtcgaggagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348735 - DNA, 1080 bp, Homo sapiens
aatgcccctctagcagagaacagagttagcactctctcgtgtaccttcttcaggtgtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348736 - DNA, 1581 bp, Homo sapiens
gggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcagggctgaggcacatgtctgggtctgagctgaccgagctgctggaccaggtggagggtgccatccgtgacttctcggaggagctggtgcagcagctggcccgccgggacgagctggagtttgagaaggaagtgaagaactcctttatcacggtgcttattgaggttcagaacaagcagaaggagcagcgagaactgatgaaaaagaggcggaaagagaaagggctgagcctgcagagcagccggatagagaagggaaaccagatgcctctcaagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348737 - DNA, 731 bp, Homo sapiens
gtctctgtaagccagtgtcttacacttactgtctagtcacagaaccctggggcgttatctgggacagcctggtagctgagaggtccctgggtgtggtgacagtgtagcaagaagcatttgcccttcttgagtctctctcccccacagcgcttcagcatggaaggcatctccaacattctgcagagtggcatccgccagacctttggctcctcaggaactgacaaacagtatctgaacacagtcattccttacgagaagaaagcctctcctccctcagtggaagacctgcagatgctgacaaacattctctttgccatgaaggaggataatgagaaggtgcctactttgctaacggactacattttaaaagtgctctgccctacctaaccttgccctttggagcagcctcgctgcaggaggtcactgagcaagagtcattccatcacagggactgcatgagaccatgtaacctccgacatgtatttaaacgtgtatagcttaacctggattaaacacgagcaagcgcgcggggtcctttgccgttggcttctagtgctagtaatcattggatgcatgatggggcagggccggtgatggtgcctcccccttgctggtgtcaggagaggggaaggcagccgctttcaccgctcattatgtagtctggctacagccctcaaaaacagcttatactcttaagactaattttgaaataaaaccttcatttaattaaa

SEQ ID NO: 348738 - DNA, 1151 bp, Homo sapiens
gggtggggtggaggcgggagcggagccgggcgccgccggagctgcgcggggagcgctcgctggctggctggctggctggctctccgctgcgctgcgctgcgctccggccgctcccgcggcccgtggatgggggtgtccggctgagccccgggatccgcctccctccgccaggacccgcacagataaactcatcctgaaagtcgctgttgttctcctgctgagcaagaatggaggccccactggtgagtctggatgaagagtttgaggaccttcgaccctcctgctcggaggacccggaggagaagccccagtgtttctatggttcatctccccaccatctcgaggacccctccctctccgagcttgagaatttttcttccgaaataatcagcttcaagtccatggaggacctcgtaaatgaatttgatgagaagctcaatgtctgctttcggaactacaacgccaagaccgagaacctagctcccgtgaagaaccagttacagatccaagaggaggaggagacccttcaggacgaggaggtttgggatgctctgacagacaattacatcccttcactctcagaagactggagggatccaaacatcgaggctctgaatggcaactgctctgacactgagatccatgagaaagaagaggaagagttcaatgagaagagtgaaaatgattccggtatcaacgaggagcctctgctcacagcagatcaggtaattgaggagattgaggaaatgatgcagaactccccagaccctgaggaagaagaggaggttctggaagaagaggatggaggagaaacttcctcccaggcagactcggtcctcctgcaggagatgcaggcattgacacagaccttcaacaacaactggtcctatgaaggtgagggccctgggcgctgggctggccgaggaggaagcacctgctcggggccaggctctgggctgtgtgctttgtacatggctaatagaaccctgactgcctcagagcagagccttgcagatctaggtggtcagcaatacctttcttactcggcatcaggagagaagtttgcatttttgagaaaagaacaaggtagtcgagcaaaatttaaatgttaaaactaaccaaagaacaagactaaggcagaataagcagaa

SEQ ID NO: 348739 - DNA, 598 bp, Homo sapiens
aggtgcatcttggcatctgcacaatgctgtgcatactcgggtactatttcgtatttagattcttgttcacaaagcatcaagtcctatttccttaaaacatttgtttcttgcttttttttttaacctattatcatactttgaggattttgagatccttacgttttgtattcccaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtaccctacctgctgactttctgggacacgcttgtcacaggaaatgaacaggctttcttaaaatttacctcaaatgttattatttgaacttttttccttaggtattaatttctggtgcacaagttcccataagcctagaggacctaaaatcctttacaaactattcaggtatgttatcactgctagttattgtttctgaaaatgttgcaggtggtcatatttccaaagtaatttt

SEQ ID NO: 348740 - DNA, 1157 bp, Homo sapiens
accccatcctgtgggcacggccttgtttggaaatagggtccaatagctgcgaggccttgtttggaaatagggtccaatagctgcgaggcgtgagttcatgtggttttcagtctcgcagtgtgtgatcatttgccgtagccaccttgggagactaacaaacctgcagttcctgaaggattcaccatccttctgttgaggaggagcatttgttggcttctgtctcacaagaaggatctgtctcttcataattccacgatttcgctcctaggtggtctgttccagagttctctgcatgcttagtgcgtgcattgaatgcctgcacgggatcctggagcacagtacctgcccactgaatatcagcttccatcttcggtactatgaggagaaaatacctgctctcttaggattgggtttaatatcaagttgagcatatggctctttgtttgtagaaggcttgtatattcgatgctaacgttgtcactgttctcttttgaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtgaggggtcaggaggaggattcacatacctgtatagcaagtagcagcatctccttgtgtgtggaagtccatttgtgttacagcgtttgacttccgcacattttagttagaatgactgtggctgtgagttagacgtcgaagcatatagctccaaagcaccttagccctggcgtctgagctgagtgcagttcctgctcccacgcatgaagcctgttcctgcccggcagcccctcctgcggagctccactctcgaggctgcggcccaggcttgctgcttgtctggctcttcccggtgctgggggtggccgttcagcagcttcccggcaggaccccttgcttagtcctcactccttgcccgctcagagccacctcagctgctccagcactgtctagggggtgtgttcattacccatctggttacttttgttacttatatcctttttaaaaa

SEQ ID NO: 348741 - DNA, 891 bp, Homo sapiens
gtgggtgatctagaggatcccgtggatgaggaagtactagagaaatgtccagcaccaattctgttcaagtgtgatcaggtcaaagtgtgtgctagagcacaggggagttctgaaccaggattgcccccgacaggtcactcagctctatgtgccagcatccagacatgtgtggaggttccggcggatggggaggataggcccgctgcagtccaccctggacggtgagttctctaggacacagggttactgaggtatgaattacatgctgtcaaattcactcctttaatctacagatctgttatttttcataaacttatacagccatgtcactcccagcaggagctaccatgtagaaaagtttcatcacccacaaaattgcctctagctccattgcggccacctcttcagcagccacccatttctgttttgtcctgtcactttgccttttgcaaaaggcctccaaagggaaccatgctgtgtagtctgctcctggctccttttggtcagcacgctgcatttgagggtgctgtgtgggttgattgttccctctgttgctcagcagtattccagtgtggggatgcaccacagtttgtgaatccattcattggttgaaagacatttggttattttttctgtctctgggaatacgagtacagctgctataaacatctatgtacaggtttttctgtgaacatacattttgtttgacatggagtaagtttcactgggagtaagaatcctgagacatttggcaagtttatgtttaacttgatgagaagctgcagaactgtgttccagggtggctgcacggctttgcattcagaccagcaatgaatgagagcctctgttgttcccagtcctcatcagcacttacagttgtcatttaaaaaa

SEQ ID NO: 348742 - DNA, 5115 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348743 - DNA, 5087 bp, Homo sapiens
  misc_feature (5060)..(5060): n is a, c, g, or t
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagaccccgnaggggtcctctagagtcgccacacgcg

SEQ ID NO: 348744 - DNA, 3045 bp, Homo sapiens
gagttatccccacctcctaccccacgacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348745 - DNA, 5266 bp, Homo sapiens
  misc_feature (4934)..(4934): n is a, c, g, or t
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctaaaaaaaaaaaaaaaanaaaaaaaaaaaaaaaaaaaaaaaaaaaaaaaaaaaaaaaaaaaaaaaaggaaaaaaaaaaaaaaaaaaaaaaaaaaaaaacttgtggcccgcttgggccaaatcaattttaaactagaccaagttaatcattgcgcccgaaattggagctaattggccaaattccccttatagggagccgtttaaaaattaattggccgacgtttaaaaacttcgaaactggaaaaaccttgggtttaccaaactaaatcgctttgcagaaaatccccttttgacaagttggcgtaataccaaaaaggcccgaacctcgcctttccagttgcccacccttgg

SEQ ID NO: 348746 - DNA, 5070 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348747 - DNA, 4929 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatcgtcctccccccctcccatctctccttcctggcccgtccctggcccaaagcacgcggtagggacggtggacgtcggcgggtcttagtgtatgatttttttgtttggatcataaagtatgcgtttgcatgctaaaaaaaaaaaa

SEQ ID NO: 348748 - DNA, 2347 bp, Homo sapiens
aggtgcatcttggcatctgcacaatgctgtgcatactcgggtactatttcgtatttagattcttgttcacaaagcatcaagtcctatttccttaaaacatttgtttcttgcttttttttttaacctattatcatactttgaggattttgagatccttacgttttgtattcccaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348749 - DNA, 2448 bp, Homo sapiens
aggtgcatcttggcatctgcacaatgctgtgcatactcgggtactatttcgtatttagattcttgttcacaaagcatcaagtcctatttccttaaaacatttgtttcttgcttttttttttaacctattatcatactttgaggattttgagatccttacgttttgtattcccaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtaccctacctgctgactttctgggacacgcttgtcacaggaaatgaacaggctttcttaaaatttacctcaaatgttattatttgaacttttttccttaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348750 - DNA, 1837 bp, Homo sapiens
  misc_feature (15)..(15): n is a, c, g, or t
gccgtcggggaggcntctctattggcagtccgagcgccgacgcaatttcaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348751 - DNA, 965 bp, Homo sapiens
aggaaaagcctgcgcgttatcgggtatgtgcaccagaaactgtcactcgtctggcgagtcgtgagcaacaccaggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348752 - DNA, 2479 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtgttattgaaagatctttttaatatttatcattaaaaaatacattcagcttgtgtctttctggagagaagaattaagcactttaaaattatttattttatgactcatatgactaaatagtaatgataaaccttattactaactcttacgccaacttcttaatggaacatatagcagtatcattgacttaaaatgatattctgagttattaatcctcaattttcctttttaacctgagattatattaaagccttaatgatt

SEQ ID NO: 348753 - DNA, 3446 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtgaggggtcaggaggaggattcacatacctgtatagcaagtagcagcatctccttgtgtgtggaagtccatttgtgttacagcgtttgacttccgcacattttagttagaatgactgtggctgtgagttagacgtcgaagcatatagctccaaagcaccttagccctggcgtctgagctgagtgcagttcctgctcccacgcatgaagcctgttcctgcccggcagcccctcctgcggagctccactctcgaggctgcggcccaggcttgctgcttgtctggctcttcccggtgctgggggtggccgttcagcagcttcccggcaggaccccttgcttagtcctcactccttgcccgctcagagccacctcagctgctccagcactgtctagggggtgtgttcattacccatctggttacttttgttacttatatcctttttaaaaa

SEQ ID NO: 348754 - DNA, 3358 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggtaaagtaaccttcatataaaaatagacctcggaccaaaagatgttgacattttatgtttatgtgtggttgttatccaggtttaccataaaatactgtttgttttaaatttggatgctaaatgttgcaaaagcactgcacgaaacaaatttgtatggttgtaagtaggtgctatggtttgaatgtcccctccaaactcatgttgaaacttgatccccagtgtgccagtattcagaggtggaatctttaagaggtgattagatcatgtgagctcggccgtcatgaatggatgagtggtttattgtgggaagggccctggtgactttttacaggagggagcccctagctttgtgatgccctgtgccgcctccggactctgcagagtccccaccaatgagaagacctcaccaggggctgcctctggaccatggtctggcttcagtatagaagattagttttatatatcagtcaaggttctgtcaagagccaacgataaagagtagctagaaatcattaaaatgggaaatcaattggggggggtaaaaaacttttgacttgggggaacacggttcgt

SEQ ID NO: 348755 - DNA, 2213 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggtatagagtatatgtatttttttgtttactgacattgaaaaatgtacaaacttttgtcttgactcgttgcagaggaataaaaatgcaggtttgtttcaga

SEQ ID NO: 348756 - DNA, 1517 bp, Homo sapiens
gccaggtgcagtggcacacacctgtaatcccagcactttgggatgctgaggcgggtggatcacttgaggtcaggagttcaagaccagcctggccaacgttgtgaaaccccatctctacaaaaagtacaaaaattaaccaggcgtgatggtatacacctgtagtcccagctactcaggaggctgaggtgggaggatcgcttgaaaccagaaggtggaggtcgcagtgggctgaggtcgcaccactgcattccagcctgggtgacggagtgagaccgtgtatcaaaaaataaaaaattgtaaggaccaaaaataagggatgagaggaactgacagatgaaaaataacttgagaaaatatactgtgtctgttttatttgaatactgcctcaaccaaattgaaaaaaaaactagaaagtgaatttttgataataataacttaatttttaaagtgatctattttgcttcataaagcaattatattattttactatgtttagatattatgcaccatcaaataaaacaattagagatttctttggggcatattagaaaacatagttaactgtaaaagtatgaaaggacagctagcatgagagaggacctgaaaaggtaaagcaaaaggggacatgaaggtatgaggtcagagagagggcccagcccacggtagagaaatgtccagcaccaattctgttcaagtgtgatcaggtcaaagtgtgtgctagagcacaggggagttctgaaccaggattgcccccgacaggtcactcagctctatgtgccagcatccagacatgtgtggaggttccggcggatggggaggataggcccgctgcagtccaccctggacggtgagttctctaggacacagggttactgaggtatgaattacatgctgtcaaattcactcctttaatctacagatctgttatttttcataaacttatacagccatgtcactcccagcaggagctaccatgtagaaaagtttcatcacccacaaaattgcctctagctccattgcggccacctcttcagcagccacccatttctgttttgtcctgtcactttgccttttgcaaaaggcctccaaagggaaccatgctgtgtagtctgctcctggctccttttggtcagcacgctgcatttgagggtgctgtgtgggttgattgttccctctgttgctcagcagtattccagtgtggggatgcaccacagtttgtgaatccattcattggttgaaagacatttggttattttttctgtctctgggaatacgagtacagctgctataaacatctatgtacaggtttttctgtgaacatacattttgtttgacatggagtaagtttcactgggagtaagaatcctgagacatttggcaagtttatgtttaacttgatgagaagctgcagaactgtgttccagggtggctgcacggctttgcattcagaccagcaatgaatgagagcctctgttgttcccagtcctcatcagcacttacagttgtcatttaaaaaa

SEQ ID NO: 348757 - DNA, 5171 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348758 - DNA, 5841 bp, Homo sapiens
  misc_feature (5187)..(5187): n is a, c, g, or t
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaaaaaaaaaaaaaaaaanaaaaaaaaaaaaaaaaaaaaaaaaaaaaaaaaggggggggcaaaaaaagggggggggagggggcacaccaagtcctgcgcggcagaccagcccataatctgtgtgaaagaacaagggcccccctatagaggagaaagcgtctaaccacagaaatgagcggacgcgtgccactatatcaaaaacacccggtgcgcacgccggtaacacaacgtgccgacaccgagagcaacaacgtgacacgcgaccaccaccacttcggagaggcgacaccccaactactgcagcgcagcacaccaaagacgacaaaacccaccccgagggaaactcacacccccagacgtacaaacaagctaccacacaagccccacttaccaacagcaacacaaaataggaccgaagaaaaaaccgcccacaagaatcatacccgagacacggctccacaaggccactgtaaaacaagcacgcccagacccacgcacagcaacgaacagccgccaccgcaacgccacgccgaacaacaaagaacaacacaaaggaccagcaacaccaacaagaacaacgccaaccaccagacaccccacgccaaaccaccagtcaaaacacaccaagcacacccacccaccaaacaaaaggcaacgacaaacagacgaccac

SEQ ID NO: 348759 - DNA, 4918 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgcta

SEQ ID NO: 348760 - DNA, 3712 bp, Homo sapiens
gccaggtgcagtggcacacacctgtaatcccagcactttgggatgctgaggcgggtggatcacttgaggtcaggagttcaagaccagcctggccaacgttgtgaaaccccatctctacaaaaagtacaaaaattaaccaggcgtgatggtatacacctgtagtcccagctactcaggaggctgaggtgggaggatcgcttgaaaccagaaggtggaggtcgcagtgggctgaggtcgcaccactgcattccagcctgggtgacggagtgagaccgtgtatcaaaaaataaaaaattgtaaggaccaaaaataagggatgagaggaactgacagatgaaaaataacttgagaaaatatactgtgtctgttttatttgaatactgcctcaaccaaattgaaaaaaaaactagaaagtgaatttttgataataataacttaatttttaaagtgatctattttgcttcataaagcaattatattattttactatgtttagatattatgcaccatcaaataaaacaattagagatttctttggggcatattagaaaacatagttaactgtaaaagtatgaaaggacagctagcatgagagaggacctgaaaaggtaaagcaaaaggggacatgaaggtatgaggtcagagagagggcccagcccacggtagagaaatgtccagcaccaattctgttcaagtgtgatcaggtcaaagtgtgtgctagagcacaggggagttctgaaccaggattgcccccgacaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348761 - DNA, 2882 bp, Homo sapiens
accccatcctgtgggcacggccttgtttggaaatagggtccaatagctgcgaggccttgtttggaaatagggtccaatagctgcgaggcgtgagttcatgtggttttcagtctcgcagtgtgtgatcatttgccgtagccaccttgggagactaacaaacctgcagttcctgaaggattcaccatccttctgttgaggaggagcatttgttggcttctgtctcacaagaaggatctgtctcttcataattccacgatttcgctcctaggtggtctgttccagagttctctgcatgcttagtgcgtgcattgaatgcctgcacgggatcctggagcacagtacctgcccactgaatatcagcttccatcttcggtactatgaggagaaaatacctgctctcttaggattgggtttaatatcaagttgagcatatggctctttgtttgtagaaggcttgtatattcgatgctaacgttgtcactgttctcttttgaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgattttagtctctacaaacagaaagcgtttcaaagcgtcagctgtgggagcagagtgaccctttgctgatgctggggggaggggatctaaatcctcatttatctcttctatgtctagtattttactgtcactggaggctctgtgggctgtcatagttaattgaccataattagcaatatacttttaaagtgggaaagctgaatgacacttttaagacaatgaacattatcaaaacaaaatgtataatttcttaatttgaataataaattaagcgtttaaatgctatttgtagtcttgatatacagaaataaaataattagggttggtcttttttattttaggttgttttatgttgaatgttctatatcttattagttaatttgtatattttattagtattttggaaatagcatatctgagactgaagagaaattgacaattcacttatttgtggtttttttctcagctattctgagcttatttatttatttgtatgttctaatggctaaacatttacattaaatgttttttttcccaa

SEQ ID NO: 348762 - DNA, 4805 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaaccaaagtggcggctgcatctttgtcccgatgctagccgtgccggtctcccatcatccgctcgccctcctttcccctgggctgcgcccacttgtcttcctggatatttgggggtgactcgccatgcttggcaccctctgcttcctggtgctgctctgactcgaagacgggacagtccctggtgcacatccagggaagaggagcgtcggtagttcttgcagtaggcactttatcaggacctgacctgttgctgggtgctggatgcggttcttggctgcctgctcctggggtggagaaccgattgtcccgggattcactgaagtctttgtaactgcaaggaccgtcttccaacccgtataattgaccaggcataatggctggactgcttggaagacacagacattcagcttctgccccaactttcaagc

SEQ ID NO: 348763 - DNA, 4382 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggttggattgtttacaagcctcattattaaaactgaaggcattttttttttctgctgcctttcccaaagtggttaggtttggaaaagagatgatgatggtaatattttatttgtgctttttaagccatttccccaaatgggactagcatgcttgttttcagtataccgtggcctgcctcatgatggtttggagatactgtctgtggatgtgaggtggggacttcattcattgtcctatttctatctccactttgtgcctggagagctttcaggggaggtggaggaggagggtctgccaagctactgcaacatctgtcacccactatacccagttacttgggggaggacagacactgtggtgtcattaaagttgtttgaacca

SEQ ID NO: 348764 - DNA, 3992 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtattaatttctggtgcacaagttcccataagcctagaggacctaaaatcctttacaaactattcaggaggctattctgcagaccatcctgttattaaggtcttctggagagttgtggaagggttcactgatgaagaaaagcgcaaactgctgaagtttgtaacaagctgctctcgaccccctctcttggggtttaaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccaagcattcagaagatgaacgggatacatctagaatcaagctatcacgaatcacggtgtcactgccgtctcac

SEQ ID NO: 348765 - DNA, 3422 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtagttgaactaaaattcggtgggaaagacatccctgtcaccagcgccaaccggattgcgtacatccacttggtggcagactacaggctgaacaggcagatccgccagcactgcctggctttccgccagggccttgccaatgtcgtcagcctcgagtggctccgaatgtttgatcagcaagaaattcaggtaccctacctgctgactttctgggacacgcttgtcacaggaaatgaacaggctttcttaaaatttacctcaaatgttattatttgaacttttttccttaggtattaatttctggtgcacaagttcccataagcctagaggacctaaaatcctttacaaactattcaggtatgttatcactgctagttattgtttctgaaaatgttgcaggtggtcatatttccaaagtaatttt

SEQ ID NO: 348766 - DNA, 3080 bp, Homo sapiens
  misc_feature (3073)..(3073): n is a, c, g, or t
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacgtgggtttggagtccccgccgctgtctgtgtctgaggaaagacagcttgctgtcctgacagagttgccttttgtggttccatttgaggaacgagtaaagatctttcagaggttgatttatgcagataagcaagaagttcaaggagatggtccatttctggatggaattaatgtcacaataagaagaaattacatttatgaagatgcttatgacaaactttctccagaaaatgagcctgatttgaaaaagcggatccgtgtgcacttgctcaatgcccatggcctggatgaagctggcattgatggtggtggtattttcagagagtttttaaatgaactactgaagtcaggatttaaccccaaccaggggttctttaagactactaatgaagggcttctgtaccccaacccggctgctcagatgcttgtgggagattcttttgccagacattactacttcctaggcagaatgcttggaaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtaaaagacctctacacggtgggaatcggtgcccagtccatagaaatggtcgtattggagcttaattctagccanagatagc

SEQ ID NO: 348767 - DNA, 2976 bp, Homo sapiens
agttccaggtgcaagcgccgggtttgctgcccgctgggcgcccctgcagcggcccgagctgtggccggcgtggatgaggggcaggcgaggcagggccgcccctccagtattgccgcccctcccgccccagggcagggctgggagggtacagcccgggggcgggctcgggtcgcctcccggccgccgcgtcctcgctgccccgggccgggcgggcgggcgccgagagcctcccagcccgccccgtgccccgcccgcccggctgcttccgcggcggcgctgcccgcacatgggctaggctgccaggatgttcagcttcgaaggcgacttcaagacgcggcccaaggtgtcccttggcggcgcgagcaggaaggaggaaaaggcttctcttttacatcgtactcaggaagaaagaagaaagagagaggaagaaaggcgaaggttgaaaaatgcaataattatccagtcatttattcgaggctatagagacagaaaacagcaatattccatccaaagaagtgcatttgatcgctgtgctaccttgtcacagtccgggggcgcttttcccattgctaatggccccaaccttacccttttggtaaggcagcttctgtttttttacaaacaaaatgaagactcaaaacgtttgatatggctgtatcagaacttaattaaacacagctctctgtttgtcaagcagttggatggatctgagagacttacatgcttatttcagataaaaagattgatgagcctctgttgcaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatgggtattataggtctctatatttgttgattaacagcaagcttccatcaagtattgaatattctgatttatctcgagttcctatagcaaaaattttgctagagaatgttctaaaaccattgcactttacttacaactcctgtccggaaggtgcgaggcaacaagtttttacagccttcacagaggagtttctggcagcaccttttacagatcagatttttcatttcatcattccggcgcttgcagatgcgcagaccgttttcccttacgagccctttctgaatgcactgttgttaatagagagtagatgttcaagaaagagtggtggagcaccctggcttttctatttcgttttaactgttggcgaaaattatttgggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggaggatggcagactgtcagtatcatacataacagaggaatgcctgaagaagctggacacaaagcagcagaccaacaccctgctcaacctggtgtggagggactctgcgagcgaggaggtcttcaccaccatggcctccgtctgccacacgctgatggtgcagcaccgcatgatggtacccaaagtcaggcttctctacagtttagcctttaatgccaggtttctgagacatctttggtttctaatatcttccatgtcaacacggatgatcacagggtctatggtaccgttgcttcaggtgatatccaggggttctcctatgtcttttgaagattctagtcgaatcatcccactcttttacctttttagctccttgtttagtcattcactaatttccatacatgataacgaattcttcggtgatcccatagaagttgtaggtcaaagacaatcatcaatgatgccttttactttagaagagctgataatgttgtctcgatgccttcgagatgcatgcctggggatcatcaagttggcttatccagaaaccaagccagaagttcgagaagaatatattacagcatttcagagtattggagttactactagctctgaaatgcaacaatgcatacagatggaacagaaaagatggattcagttatttaaggttatcaccaatctagtgaaaatgttgaagtccagagacacgaggagaaatttttgtcctccaaaccactggctgtcagaacaagaagatattaaagcagataaggtcactcagctctatgtgccagcatccagacatgtgtggaggttccggcggatggggaggataggcccgctgcagtccaccctggacggtgagttctctaggacacagggttactgaggtatgaattacatgctgtcaaattcactcctttaatctacagatctgttatttttcataaacttatacagccatgtcactcccagcaggagctaccatgtagaaaagtttcatcacccacaaaattgcctctagctccattgcggccacctcttcagcagccacccatttctgttttgtcctgtcactttgccttttgcaaaaggcctccaaagggaaccatgctgtgtagtctgctcctggctccttttggtcagcacgctgcatttgagggtgctgtgtgggttgattgttccctctgttgctcagcagtattccagtgtggggatgcaccacagtttgtgaatccattcattggttgaaagacatttggttattttttctgtctctgggaatacgagtacagctgctataaacatctatgtacaggtttttctgtgaacatacattttgtttgacatggagtaagtttcactgggagtaagaatcctgagacatttggcaagtttatgtttaacttgatgagaagctgcagaactgtgttccagggtggctgcacggctttgcattcagaccagcaatgaatgagagcctctgttgttcccagtcctcatcagcacttacagttgtcatttaaaaaa

SEQ ID NO: 348768 - DNA, 337 bp, Homo sapiens
cgccctaaggacactgtgtgggctgttgcaggtcctcctgaccaggacgcgacttccctgaggcggaggaggagctgaggacgaacaaggactgggctgggtccagctggtgggcgtagggctggccagtgccttggcctttaacctgcagcgtcctgggtctctttggcccagccagtcgtgaggactgtggcccaggatgctgccgaacagtgagggtgcccattgtggactggaatccagctagctattcctcattcgagaccccatagaaccccacaaacatgattggggttgacatggattttgaatattaaagttacatgagatttctgaa

SEQ ID NO: 348769 - DNA, 407 bp, Homo sapiens
aaaatggtaccactggggaaaacttgccaagggatctcactgtattattcttatatgactgagtgcaaatctacagtcttctcaaaaattttaattaaaaattcgaggagaatatgttgggaagaaacaatataaggggcaaagtggaagacagaattgaaatgtcatttctgagagatgacgagcactaatagattagaaagtaagagaacactgggatccaaggtgggcaaggacattgattgcaacattgggagccggagccattggaagtctttgagtaggagactgtcactataagaccagatgcctaataatcccaaaggggctctacacctctgaaattgcataccttgaagaagagtcatcagaagtgtgcacaacagagtgtggtggagtcagagacc

SEQ ID NO: 348770 - DNA, 653 bp, Homo sapiens
ttagaaactgcaatttgaagtgaaactacgtatatggaaaccagttttcccataggctaattgatacaaacaagattaagtttctgtggcatatttctgttcacaaaaacaccaccaaacttttaagtaaagaccaaaacacttctagcattaaacgttgaaataaatgtgagccatacctatatttaagaaagattaatgcaacgtgagataattcttacccacttattccacctggtcacaggtggtcagagcctatcctaggagctcagggcacacggcgggcaccagtcctggacagggtgccatcccatcacagggcacactcacactcacacccgcacccatgtccttagactgggaccaggtaaatgcgttaataaacctaatgtgcccagctttgtctgggaggaaacccaggtacccagagagaaaaaccaccagacagtggcccggttgggaatggatttttcttatcaactgtgtaactaaatgatggtcaatgaaacgatgttatttgaggatgtgctgtatactaaaatatatggaattctatttggtttgtgtgttagtaacccctggggatggattcagatgatctgaaaattccttattgaggctgtgcatggtggctcacacctgtattcccagca

SEQ ID NO: 348771 - DNA, 404 bp, Homo sapiens
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagccttttaagacccgtcctcggccgagtcgctaaccagcgggtaccttgcctatgtt

SEQ ID NO: 348772 - DNA, 1720 bp, Homo sapiens
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcctcctggaaaaaaaaaaaaaaaaaaaaaaaaaaaaaaaaaaaaaaaaagaaaaaaaaaaaaaaaaaaaaaaaaaaaaaaaaaaagaaaaaaaaaaaaaaagaaataaaaaaagaaaataaaagaaaaaagaaaaaaagaaaaaaaaaaaaaagggggggggggaagtaaggggtctctacagaggcgacgacaccaaaaccaacaacaaccacccccacacgtctgaaaaacaaaagaagggcgaccacaaccaagcatactaacataaacctcaaagacgccagcggtgaggtaaaaaacaacgtggttgcgggaaagacagccactctcatagatattagtagaagaacccaacacaacacggcggaggacaaaaaccaaacggacacccccacaaaacgaaagtggccccagaggaaaaaaaccccagcgtggagtcggggaaaaccaaccaccatctgccctcgggcagcgcaaaagggccggagcaaaacatacaaacgtgcccccccccacaaccagcaccggggaacgagacggcaagcaggaccaacggccgcacggaaacgcggcgcgatgcaacgagccaaccgaccacactagcaacaagagacatgcgcggacaccagaggaagcgcaggcaaagacgagcaagcaagacggagcgagagcgaagctcagagccacgagcaccgagccaggtc

SEQ ID NO: 348773 - DNA, 1153 bp, Homo sapiens
  misc_feature (1082)..(1082): n is a, c, g, or t
  misc_feature (1086)..(1087): n is a, c, g, or t
  misc_feature (1093)..(1093): n is a, c, g, or t
  misc_feature (1096)..(1096): n is a, c, g, or t
  misc_feature (1102)..(1102): n is a, c, g, or t
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcacaaaaaaaaaaaaaaaaaaaaaaaaaaaccccgggggcatatattgcgggggggggaaaaaagggntttnnaagggnccntgggtnaaaggtttccggaccccctttttttttccaagggggaaaatggggggccca

SEQ ID NO: 348774 - DNA, 1271 bp, Homo sapiens
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcaaaacaaaaaaaaaaaaaaaaaaaatcaaaacaaaaaaataaaactaaaaaaacacacaaaacaaaaacacaacagcgaaccaacctacgaaaccacaccagagcaatcattaccactctcggcgcggagaggagacgacgcctcgaggcccgcctagagaggagcgggcggcgatgcagagaagatgaagaggggaggcaccgcgcgccgcggggaaatacggggcgtgcgatcgatcggagggaagggaagccg

SEQ ID NO: 348775 - DNA, 1430 bp, Homo sapiens
  misc_feature (1025)..(1025): n is a, c, g, or t
  misc_feature (1032)..(1032): n is a, c, g, or t
  misc_feature (1038)..(1038): n is a, c, g, or t
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcaaaaaaaaanaaaaaanaaaaanaaaaaaaaaaaaaaaaaaaaaaaaaaaaaaaaaaaaaaaaaaaaaaaacacaacaaacgaaaaacaaaaaaaaaaacagggggggccgagaaaaaaacacagacgccaggagcccaacccagcaacaccactcaccctgacaacaagaagggcacccaccaagaagcacgaacaccaaacgacaagcgccgcacaagcaacaaatcgaacaggatcggaagacaacacagaacagcagccaggaagagcgagacaacaacgaagcgggatgagaaaaaagcgaaccaaaacacagacagcaatcgggcaggacacaaaacgaacagcgaacgacggacaacacaccacgcgaccgcgcggaaagcaagaacacgagacgccgtcacacaacg

SEQ ID NO: 348776 - DNA, 978 bp, Homo sapiens
  misc_feature (907)..(907): n is a, c, g, or t
  misc_feature (911)..(912): n is a, c, g, or t
  misc_feature (918)..(918): n is a, c, g, or t
  misc_feature (921)..(921): n is a, c, g, or t
  misc_feature (927)..(927): n is a, c, g, or t
cccagaatggggtcgcttttgtcgggtctcactgtattcgaacccccgcagtcatagagaaggcctagcagcggcttgactcccccgtctctcagattcttggagtaagcgctgctctccattcttcattcccagggtacctgcttctcccagtccctaacgtaggtcgcctccgagcacagccctaaaatcggggcctcccaagggctagactatgagcctttactggtggttgccaaggtgtggtatctcacccgtcctacaggaaccaaagcggggagtgtgttcagtcagtacctgcctttctgagcctggcatcctggaccagcctcacttccttggctgaggcagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcacaaaaaaaaaaaaaaaaaaaaaaaaaaaccccgggggcatatattgcgggggggggaaaaaagggntttnnaagggnccntgggtnaaaggtttccggaccccctttttttttccaagggggaaaatggggggccca

SEQ ID NO: 348777 - DNA, 1369 bp, Homo sapiens
  misc_feature (1298)..(1298): n is a, c, g, or t
  misc_feature (1302)..(1303): n is a, c, g, or t
  misc_feature (1309)..(1309): n is a, c, g, or t
  misc_feature (1312)..(1312): n is a, c, g, or t
  misc_feature (1318)..(1318): n is a, c, g, or t
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagggtacctgcttctcccagtccctaacgtaggtcgcctccgagcacagccctaaaatcggggcctcccaagggctagactatgagcctttactggtggttgccaaggtgtggtatctcacccgtcctacaggaaccaaagcggggagtgtgttcagtcagtacctgcctttctgagcctggcatcctggaccagcctcacttccttggctgaggcagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcacaaaaaaaaaaaaaaaaaaaaaaaaaaaccccgggggcatatattgcgggggggggaaaaaagggntttnnaagggnccntgggtnaaaggtttccggaccccctttttttttccaagggggaaaatggggggccca

SEQ ID NO: 348778 - DNA, 1239 bp, Homo sapiens
  misc_feature (1168)..(1168): n is a, c, g, or t
  misc_feature (1172)..(1173): n is a, c, g, or t
  misc_feature (1179)..(1179): n is a, c, g, or t
  misc_feature (1182)..(1182): n is a, c, g, or t
  misc_feature (1188)..(1188): n is a, c, g, or t
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaaggaaccaaagcggggagtgtgttcagtcagtacctgcctttctgagcctggcatcctggaccagcctcacttccttggctgaggcagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcacaaaaaaaaaaaaaaaaaaaaaaaaaaaccccgggggcatatattgcgggggggggaaaaaagggntttnnaagggnccntgggtnaaaggtttccggaccccctttttttttccaagggggaaaatggggggccca

SEQ ID NO: 348779 - DNA, 1798 bp, Homo sapiens
  misc_feature (1727)..(1727): n is a, c, g, or t
  misc_feature (1731)..(1732): n is a, c, g, or t
  misc_feature (1738)..(1738): n is a, c, g, or t
  misc_feature (1741)..(1741): n is a, c, g, or t
  misc_feature (1747)..(1747): n is a, c, g, or t
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagggtacctgcttctcccagtccctaacgtaggtcgcctccgagcacagccctaaaatcggggcctcccaagggctagactatgagcctttactggtggttgccaaggtgtggtatctcacccgtcctacaggaaccaaagcggggagtgtgttcagtcagtacctgcctttctgagcctggcatcctggaccagcctcacttccttggctgaggcaggttctcactctgtcgcccaggcttagggtgcagtggtgccatcacagcttactgcagcctcgacctctcaggcccaagcaattctcccatctgagcctcctgagtagctgggactacaggcgtgtgctaccaccatacccagccaattgttttatttttttgtagagatgcggtctcatcgtgttgcccacgctagtctaaaacttctggggtcaagtgatcttcccacctcatcttcctaaagtgctgggattacagccgtgagctaccatatctgacccctttttgaattattattatttttggtgctgctgagaatatgcatcttttagaaggcagtagatcccaaagaccaacataggatgttttacctagaagacaaattgtacattgggctttaaggactcatgaaaccattgcctgtttcagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcacaaaaaaaaaaaaaaaaaaaaaaaaaaaccccgggggcatatattgcgggggggggaaaaaagggntttnnaagggnccntgggtnaaaggtttccggaccccctttttttttccaagggggaaaatggggggccca

SEQ ID NO: 348780 - DNA, 916 bp, Homo sapiens
  misc_feature (845)..(845): n is a, c, g, or t
  misc_feature (849)..(850): n is a, c, g, or t
  misc_feature (856)..(856): n is a, c, g, or t
  misc_feature (859)..(859): n is a, c, g, or t
  misc_feature (865)..(865): n is a, c, g, or t
taatgccaatattctcactgattttgggggactgatgttggaagatgactcatggaattaagaggatcagatggttcaaagaatcttgccctatcaaagttgtttacagcctaaaaatatttgataaatgaaggtatgttcaaagccttctcattctccaaagcagtgctgctgagaatatgcatcttttagaaggcagtagatcccaaagaccaacataggatgttttacctagaagacaaattgtacattgggctttaaggactcatgaaaccattgcctgtttcagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcacaaaaaaaaaaaaaaaaaaaaaaaaaaaccccgggggcatatattgcgggggggggaaaaaagggntttnnaagggnccntgggtnaaaggtttccggaccccctttttttttccaagggggaaaatggggggccca

SEQ ID NO: 348781 - DNA, 1090 bp, Homo sapiens
  misc_feature (1019)..(1019): n is a, c, g, or t
  misc_feature (1023)..(1024): n is a, c, g, or t
  misc_feature (1030)..(1030): n is a, c, g, or t
  misc_feature (1033)..(1033): n is a, c, g, or t
  misc_feature (1039)..(1039): n is a, c, g, or t
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcacaaaaaaaaaaaaaaaaaaaaaaaaaaaccccgggggcatatattgcgggggggggaaaaaagggntttnnaagggnccntgggtnaaaggtttccggaccccctttttttttccaagggggaaaatggggggccca

SEQ ID NO: 348782 - DNA, 1397 bp, Homo sapiens
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgccaggaaatatttcctggctcctggaaaacaaaaaacaacaaaaacacaaaaaaaaaagaacagcgcgagagtaaaacaccaataacaagttgccctcccacagcagggtggtgctcatatctccacactggtgggtcaaagggcggtaacccacaacattggggggggccctatctaccacgttggtgctccaagcagctaattttgtgtacaaaccacggcttttgacacatttgcgggtccaaaagaagtccaacagaatttcacgagcgtcgcgaggacaacatcgcgcaagcagtcacgtgtccggacacactgcaagctgctcagatgctcgacagtaatgcgtacacaagcgatagaatccgataaaagttgctgaataaacccacggagatctt

SEQ ID NO: 348783 - DNA, 1100 bp, Homo sapiens
  misc_feature (1029)..(1029): n is a, c, g, or t
  misc_feature (1033)..(1034): n is a, c, g, or t
  misc_feature (1040)..(1040): n is a, c, g, or t
  misc_feature (1043)..(1043): n is a, c, g, or t
  misc_feature (1049)..(1049): n is a, c, g, or t
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccatggcccagagggcccttgctggctactgggtgttagtttgcagtcctgtgtgcttccctctcttatgactgtgtccctggttgtcaataaaatatttcctggcacaaaaaaaaaaaaaaaaaaaaaaaaaaaccccgggggcatatattgcgggggggggaaaaaagggntttnnaagggnccntgggtnaaaggtttccggaccccctttttttttccaagggggaaaatggggggccca

SEQ ID NO: 348784 - DNA, 897 bp, Homo sapiens
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtcttcggtctttgggatcctctagaaca

SEQ ID NO: 348785 - DNA, 1794 bp, Homo sapiens
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgtgagtttggagtgagaatgacagcatggcgatcttatgtgaagatgagaagaggagagggggcacgtactgaggaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcctcctggaaaaaaaaaaaaaaaaaaaaaaaaaaaaaaaaaaaaaaaaagaaaaaaaaaaaaaaaaaaaaaaaaaaaaaaaaaaagaaaaaaaaaaaaaaagaaataaaaaaagaaaataaaagaaaaaagaaaaaaagaaaaaaaaaaaaaagggggggggggaagtaaggggtctctacagaggcgacgacaccaaaaccaacaacaaccacccccacacgtctgaaaaacaaaagaagggcgaccacaaccaagcatactaacataaacctcaaagacgccagcggtgaggtaaaaaacaacgtggttgcgggaaagacagccactctcatagatattagtagaagaacccaacacaacacggcggaggacaaaaaccaaacggacacccccacaaaacgaaagtggccccagaggaaaaaaaccccagcgtggagtcggggaaaaccaaccaccatctgccctcgggcagcgcaaaagggccggagcaaaacatacaaacgtgcccccccccacaaccagcaccggggaacgagacggcaagcaggaccaacggccgcacggaaacgcggcgcgatgcaacgagccaaccgaccacactagcaacaagagacatgcgcggacaccagaggaagcgcaggcaaagacgagcaagcaagacggagcgagagcgaagctcagagccacgagcaccgagccaggtc

SEQ ID NO: 348786 - DNA, 997 bp, Homo sapiens
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggatggggaaggcaggccagaagggaatggagacattcgagccccctcaggagtgatgcgatctgt

SEQ ID NO: 348787 - DNA, 893 bp, Homo sapiens
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgtgagtttggagtgagaatgacagcatggcgatcttatgtgaagatgagaagaggagagggggcacgtactgaggtggatcaggggtgcctcttgtttttggtgcctaagactctttggcaatctggtgaagcctctaagccccttctcagaataagattttttcaggcataaaacaaaatatatagaattaaaggaaaactaattatattgaaatagttattaaaatactaaaac

SEQ ID NO: 348788 - DNA, 763 bp, Homo sapiens
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtcttcggtctttgggatcctctagaaca

SEQ ID NO: 348789 - DNA, 156 bp, Homo sapiens
cccagaatggggtcgcttttgtcgggtctcactgtattcgaacccccgcagtcatagagaaggcctagcagcggcttgactcccccgtctctcagattcttggagtaagcgctgctctccattcttcattcccaggcgtacctgcattctcccagc

SEQ ID NO: 348790 - DNA, 1478 bp, Homo sapiens
  misc_feature (1073)..(1073): n is a, c, g, or t
  misc_feature (1080)..(1080): n is a, c, g, or t
  misc_feature (1086)..(1086): n is a, c, g, or t
ctaagccttctgggccacgccaacaggttcctctagttgccggcgagaactactagccgacgaattccagcttcggcggcggcagggcgaggccttctggataacagagttcacgcactgaggttgctgttggatccgagggggttagactacaactcccagggggaaacgggcgggaccgcctcctggcacgatgggagatgtagttcgttctgcccccacttttcgctagcccgggctcgccagggactctcagaatcgcagagtcgtcatctctgctgttgctaaactggatgcctcattccaatttacgacgtcactgaaccgaaacgcgggagcaaccctgagcctttccggaacccagtggggggggggggggggggggacccagacaggtgacccggaagtagaagtggcccttgcaggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttaggtggttcagtccttcacctggtgttggctctgagaggaggaggtggtcttaggcagtgatggaccctccattttacctctttaccctgtcgctcataatgaggcatcatatatcctctcactctctgggacaccatagccactgccccctcccctggatgcccagtaatgtatgtctactggtgggagactgtgaggatcccaggattcagtattcctggcccagagggcccttgctggctactgggtgttagtttgcagtcctgtgtgcttccctctcttatgactgtgtccctggttgtcaataaaatatttcctggcctcctggaaaaaaaaaaaaaaaaaaaaaaaaaaaaaaaaaaaaaaaaaaaaaaaaaanaaaaaanaaaaanaaaaaaaaaaaaaaaaaaaaaaaaaaaaaaaaaaaaaaaaaaaaaaaacacaacaaacgaaaaacaaaaaaaaaaacagggggggccgagaaaaaaacacagacgccaggagcccaacccagcaacaccactcaccctgacaacaagaagggcacccaccaagaagcacgaacaccaaacgacaagcgccgcacaagcaacaaatcgaacaggatcggaagacaacacagaacagcagccaggaagagcgagacaacaacgaagcgggatgagaaaaaagcgaaccaaaacacagacagcaatcgggcaggacacaaaacgaacagcgaacgacggacaacacaccacgcgaccgcgcggaaagcaagaacacgagacgccgtcacacaacg

SEQ ID NO: 348791 - DNA, 218 bp, Homo sapiens
aaccaaagcggggagtgtgttcagtcagtacctgcctttctgagcctggcatcctggaccagcctcacttccttggctgaggccaggttagttaccgctgccctagttcttgctactagccatggtttccttcatctgcatctctcaactcccgtggtggttcttcaccaatttccagccctcgttagtcctatctgctgtttcctcttttgtgcctt

SEQ ID NO: 348792 - DNA, 438 bp, Homo sapiens
accactgccaagaaaaagatcttttcatatccccccgtcctctcttcacttggatggcagttgagtctctgaaagagattcatcccgaaggtcttttaagtgaagagaggcaaagcttagcttagtatttcctttctgaagagcacatacccctgtgtaaaattgaggagcaacagccttaaatggaagcagctgtgattccccgcccctgtgaaggggctgtggccctgcagatgccacggctgtggatgcgtagagcttgggtaccctccctggcttcatggctgacctgctgtgtgaccttgggcaagtcagatttcctctctgtttgccatctgcaaaatatggatacagacccgtgctccctcctggttttactgaggtactgtgagagccagtgaaatcacggttatgggatgctcagcattctgctgcaga

SEQ ID NO: 348793 - DNA, 594 bp, Homo sapiens
ggaataaataaaatgcctgggacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggcccaaaggggatacgacccttcagcaaactgacatgctgaaagctgccctatggagaggctcatgtggcaaggaacagagggtggcttctggccaacacccagtgaggaactcaggccctcagtcaaacagcctgcaaggaactgaaccctgccaataaccctgggttgaaagcttccctttggagaagaactgagggctgtctctggtcaatagcactgaggaactgaatccagcaaacaattatgtgaagaaacttggaagcttgtcctcccctctagttgagctttgagatgactgccgccctagtggacaccttgattgaagccttatgagaaaccctaagccagagaacccaattaagctacgcttacattcctaacacagagaaaatatgagctaataaatgttgtttcaaaccactaaaaatt

SEQ ID NO: 348794 - DNA, 728 bp, Homo sapiens
tgttcaggctgctgggtgacatttctatgtctccccttcaacggtgaaatatttcagtggttgtccatcacctatgggagtctgacatggcataatcaggccactggggcattgctagttgtgctgtccctgatattcaccgtggtaggcagtttctgaaatggctcccagtgatctccaactcctgaaattcacactctgtgtaatcccctccctttgagtgtgggctagacctggtggccaaagtgataggatttcacttctgatgttaggctatgaaaggctgtgaccgctctctctgcctcttctctctcacttgaagcaaactgacatgctgaaagctgccctatggagaggctcatgtggcaaggaacagagggtggcttctggccaacacccagtgaggaactcaggccctcagtcaaacagcctgcaaggaactgaaccctgccaataaccctgggttgaaagcttccctttggagaagaactgagggctgtctctggtcaatagcactgaggaactgaatccagcaaacaattatgtgaagaaacttggaagcttgtcctcccctctagttgagctttgagatgactgccgccctagtggacaccttgattgaagccttatgagaaaccctaagccagagaacccaattaagctacgcttacattcctaacacagagaaaatatgagctaataaatgttgtttcaaaccactaaaaatt

SEQ ID NO: 348795 - DNA, 570 bp, Homo sapiens
ggaataaataaaatgcctgggacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggcccaaaggggatacgacccttcagcaaactgacatgctgaaagctgccctatggagaggctcatgtggcaaggaacagagggtggcttctggccaacacccagtgaggaactcaggccctcagtcaaacagcctgcaaggaactgaaccctgccaataaccgctgagctctgaaacttctcctggcagttcaagagagcgatggagggaatgctggggcacatctaaataaagcctccaagtgggagttcctgctcagctatgcatgagctctttgtgacttcatctcccagcctacaacttgtgaaataagcacgacttcactcagagcacagccagaaacatacaaactttccaaaaatatttgaatgttgacagcaaaatgtcttgcattccagtgaataatt

SEQ ID NO: 348796 - DNA, 540 bp, Homo sapiens
ggaataaataaaatgcctgggacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggcccaaaggggatacgacccttcagcaaactgacatgctgaaagctgccctatggagaggctcatgtggcaaggaacagagggtggcttctggccaacacccagtgaggaactcaggccctcagtcaaacagcctgcaaggaactgaaccctgccaataacccactgaggaactgaatccagcaaacaattatgtgaagaaacttggaagcttgtcctcccctctagttgagctttgagatgactgccgccctagtggacaccttgattgaagccttatgagaaaccctaagccagagaacccaattaagctacgcttacattcctaacacagagaaaatatgagctaataaatgttgtttcaaaccactaaaaatt

SEQ ID NO: 348797 - DNA, 472 bp, Homo sapiens
tgggcaactgcaacaatgagcagtttgtgtctgtgcctgcatccatccttccatcctgtactccagcagcagccagggtggtctttcaaaaatgcaaagctgataatgttactcccctgctgtaaaccttccagcggtttcctattgccttcagaataaaatacgaatcatctggcctccatctatctctccaggctcatcctctctcaattttccatatccttcaggctgagctctgaaacttctcctggcagttcaagagagcgatggagggaatgctggggcacatctaaataaagcctccaagtgggagttcctgctcagctatgcatgagctctttgtgacttcatctcccagcctacaacttgtgaaataagcacgacttcactcagagcacagccagaaacatacaaactttccaaaaatatttgaatgttgacagcaaaatgtcttgcattccagtgaataatt

SEQ ID NO: 348798 - DNA, 569 bp, Homo sapiens
tgggcaactgcaacaatgagcagtttgtgtctgtgcctgcatccatccttccatcctgtactccagcagcagccagggtggtctttcaaaaatgcaaagctgataatgttactcccctgctgtaaaccttccagcggtttcctattgccttcagaataaaatacgaatcatctggcctccatctatctctccaggctcatcctctctcaattttccatatccttcagtatcctgttgggacagacagatgaagaaccagagaccagagagtttaagtagcttgccaaaggtcacacagcagtgtaagcagtacgggtgattcttaagcccacattgtttgacttccgagacatatcagaaaactacgtcaaagaacacgcacaactcagacctatttccagtggcctatgcagaagagctaccctgcttgaatggaaaccccttaagatacactattctcaaaaacctaagtgcttagcctggcttatggaggaggcaatgcaatctaccacaagatgattaagacaacaatgaacttaagtcccagccactgctggagaatatcaaaa

SEQ ID NO: 348799 - DNA, 975 bp, Homo sapiens
ggaataaataaaatgcctgggacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggcccaaaggggatacgacccttcagcaaactgacatgctgaaagctgccctatggagaggctcatgtggcaaggaacagagggtggcttctggccaacacccagtgaggaactcaggccctcagtcaaacagcctgcaaggaactgaaccctgccaataaccgcagtgtcagcccccggccaatgaccaccatggacctccctgtagttgaacaaagttgggtttgctgactggtggcagtgagggagaatgcacaccacagggagctgtgcagtgtctcagtaagaagccaggagccatcccgtgaggccgttactgcaaacaagctgaaaatcctgctttgtttcttttggacacaacatgctttccttcagcttcagtagacgatgaggccagcaccacatgggctagatgtacatgagatgtgagcaaccacacttcccctctgacggggacagacagcatcacagtatcctgttgggacagacagatgaagaaccagagaccagagagtttaagtagcttgccaaaggtcacacagcagtgtaagcagtacgggtgattcttaagcccacattgtttgacttccgagacatatcagaaaactacgtcaaagaacacgcacaactcagacctatttccagtggcctatgcagaagagctaccctgcttgaatggaaaccccttaagatacactattctcaaaaacctaagtgcttagcctggcttatggaggaggcaatgcaatctaccacaagatgattaagacaacaatgaacttaagtcccagccactgctggagaatatcaaaa

SEQ ID NO: 348800 - DNA, 878 bp, Homo sapiens
ggaataaataaaatgcctgggacatcatcgttaagtggcatctgatgcataagcagtgccctaggaatggggttgcctgccttggtctctaaaggatgggttcaaaaggcaagagcagcacacaagaagatagcttcaagcaggagaaaaagcttggcccagggcccaaaggggatacgacccttcagcaaactgacatgctgaaagctgccctatggagaggctcatgtggcaaggaacagagggtggcttctggccaacacccagtgaggaactcaggccctcagtcaaacagcctgcaaggaactgaaccctgccaataaccgcagtgtcagcccccggccaatgaccaccatggacctccctgtagttgaacaaagttgggtttgctgactggtggcagtgagggagaatgcacaccacagggagctgtgcagtgtctcagtaagaagccaggagccatcccgtgaggccgttactgcaaacaagctgaaaatcctgctttgtttcttttggacacaacatgctttccttcagcttcagtagacgatgaggccagcaccacatgggctagatgtacatgagatgtgagcaaccacacttcccctctgacggggacagacagcatcacaggctgagctctgaaacttctcctggcagttcaagagagcgatggagggaatgctggggcacatctaaataaagcctccaagtgggagttcctgctcagctatgcatgagctctttgtgacttcatctcccagcctacaacttgtgaaataagcacgacttcactcagagcacagccagaaacatacaaactttccaaaaatatttgaatgttgacagcaaaatgtcttgcattccagtgaataatt

SEQ ID NO: 348801 - DNA, 469 bp, Homo sapiens
taaatttctttctcttctggtattcatgtccttgtgcagtcccctccctttgtgtgtgggctggacctagtgatttgcttctaaagaatagaatacagaaaaagtgatagaatgtcacttctcatatcaggttataaaagactgtcacttctgtcttatcctctctctctggctctactctctggcttgctctgatgaagcagctgggttgaaagcttccctttggagaagaactgagggctgtctctggtcaatagcactgaggaactgaatccagcaaacaattatgtgaagaaacttggaagcttgtcctcccctctagttgagctttgagatgactgccgccctagtggacaccttgattgaagccttatgagaaaccctaagccagagaacccaattaagctacgcttacattcctaacacagagaaaatatgagctaataaatgttgtttcaaaccactaaaa

SEQ ID NO: 348802 - DNA, 998 bp, Homo sapiens
aagagaagagtcctccaagcagcagggaagcaagtgcaaaggtccttgcagaagcgagcttggcatattagagggacagagggaggccggagcaactggagggtcttcagagactatcaagtgccaacaaggggattacccctctgcccctctaaaggattgcaagaaagaagacaccaaatccatggcattttttcccttaggaaagaagggagataatgagaagcctccacttgcaaactgacatgctgaaagctgccctatggagaggctcatgtggcaaggaacagagggtggcttctggccaacacccagtgaggaactcaggccctcagtcaaacagcctgcaaggaactgaaccctgccaataaccgcagtgtcagcccccggccaatgaccaccatggacctccctgtagttgaacaaagttgggtttgctgactggtggcagtgagggagaatgcacaccacagggagctgtgcagtgtctcagtaagaagccaggagccatcccgtgaggccgttactgcaaacaagctgaaaatcctgctttgtttcttttggacacaacatgctttccttcagcttcagtagacgatgaggccagcaccacatgggctagatgtacatgagatgtgagcaaccacacttcccctctgacggggacagacagcatcacaggacatgaagttctaagaggttcagtgacttgtctaagattaaacagctatgaatggagaactggaggcaaatgctgagctctgaaacttctcctggcagttcaagagagcgatggagggaatgctggggcacatctaaataaagcctccaagtgggagttcctgctcagctatgcatgagctctttgtgacttcatctcccagcctacaacttgtgaaataagcacgacttcactcagagcacagccagaaacatacaaactttccaaaaatatttgaatgttgacagcaaaatgtcttgcattccagtgaataatt

SEQ ID NO: 348803 - DNA, 1148 bp, Homo sapiens
agaacgagatcctgtttcaaaaaaaaaaaaaagaaagaaaaagaaaaaagaaaataacaaaactgcttagctgctattactactttattcacagcaatctgtgccctaacacaaaataacattttaaaaaatcattgccttttccacctcaaacctaggtctcctaattgtcactagtggcattaatcaaccacatttagcatttcttcacatctgtacacatgtattcctgaaacatatactttttctatgctctggatccattattcgtaccctgaatgatgaaaaatattctagaaaactaggaggcctatttaaaactatactctttatgtctttactcatttttagaagtctacacttaatagatatgcctttccttaaaggcttctactccaaagatttaattattaaaaccgcaacgtatgctaacacctgagccctttaaatcatgcttattgtcacctccctaagagctgtctatagtactcaaattattttctttccagtcctgggacaaccctgcttttcaactttaactcaaatcaacaaaaacagccccctccgagctaattcaattgaatgtcttgcaatcagtattattttcactaaatttttttatctccaaaaatattattcccataactattccccaaatgactatgccactctacctaaaactcttagctcatgctttaactaccttaagtttcattataacattagaactcaactaataacataaaatcttaaatttgaatcctcatacatacacaaattttccaaccttctaggtttcttcccaacagttgttcatggtttatcaccatacctaaacttttcaacaaacctaaacatagcaccagttttagtagatatgactagaaaaagtcactctaaaaatcatttctaacttccaaatgatagtttcaataaccatctcctaatgaaagtattttcttctccttccttatctcacttttactggctatactcctagctatctaatttcccagagtaatctcagtaacaataaagataccaacaaataaagatcaactggccacagccatgagtcggccttcataactatataatgctgttatacctacagaaacttcctgaagacgttcaaactcttcaccctc

SEQ ID NO: 348804 - DNA, 1672 bp, Homo sapiens
gtaggtgggtgtggtgggagcctctgcaatcccagcattcccttcgtgccgctaccaagatggcggcgcccatcttgcggtccttttcctggggccggtggtctggtaccctaaatctctcagtattgttgcccttggggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtggggggtcacttccgcatggggacgctgctgagccggcagagcgtgcagctgcggctcaagagccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtgatgaaaagtccttctggttgtccaaataaacttacccatcattcattctcaagacctctgaagggttggctccagaacttagacctttgcttatgcaaatcagaaaaacagaatggactaggactcagtgtgagtaacttcattatttttatgggccggttaataaatatttgtttaata

SEQ ID NO: 348805 - DNA, 1207 bp, Homo sapiens
acagcacgcgctaacaatatgcaatatgtaatgaaagattctaaggatgttatatcctttaatctaataaacttacttctacaaatttatcctcagtgtttacttggacacaaagccccaaagacagatgcaggtagtccatcacagcttatatgtgtatataacagaaaacaaactatccagtagtaggagactggcctaacaaatgagggtatatctaaaaagtaaaatactatgcaaatcttcagactgataatgtatgagacagaaagttatttgttacatgatttgagaaatgattccaagataggtatagcatctgatttttaaagacatgtagtataggcatctatgtgttgtagatgcatacaaaaatgcctaggtcaatgccaaattttaggaattatctcaggttggtgaaattaagagtggtttttttttccattttcagagatagggtctctttttttagcgccatctgcttgcagtgctgcctcttgctcctccccaccaccactgctgccctgagtcactgcctgcacagctccagccgcctggcttctcatagtagccactgatatttggagttcttacaacatggcagacattgacaacctgcctagctagggtagttaaaagaggagtgaatgctctcaaaaacctgcaagttaaaggtgcacagatagaagccaaattctatgaggaagttcacgatcttgaaaggaagtatgctgttctctatcagcctctatttgataagcaatctgagattactaatacaatttatgaacctacagaggaagaatgtgaatggaaaccagatgaagaagatgagatttcagaggagttgaaagaaaaggccaagactgaagatgagaaaaacgatgaagaaaaagaagaccccaaaggaattcctgaattttggttacctgtttttaagaatgttgacttgctcagtgatatgcttcagaaacatgatgaacctattctgaagcatgtgaaagataccaaagtgaagttctcagatgctggcctgcctatgagttttgtcttagaatttcaatttgaacccagtaaatattttacaaatgaagtgctgacaaagacatataggatgaggttagaaccagaaccagatgattctgatcacttttcctttgatggacaagaaattatgggttgtacagggggccagatagattggaaa

SEQ ID NO: 348806 - DNA, 505 bp, Homo sapiens
acagcacgcgctaacaatatgcaatatgtaatgaaagattctaaggatgttatatcctttaatctaataaacttacttctacaaatttatcctcagtgtttacttggacacaaagccccaaagacagatgcaggtagtccatcacagcttatatgtgtatataacagaaaacaaactatccagtagtaggagactggcctaacaaatgagggtatatctaaaaagtaaaatactatgcaaatcttcagactgataatgtatgagacagaaagttatttgttacatgatttgagaaatgattccaagataggtatagcatctgatttttaaagacatgtagtataggcatctatgtgttgtagatgcatacaaaaatgcctaggtcaatgccaaattttaggaattatctcaggttggtgaaattaagagtggtttttttttccattttcagagatagggtctctttttttagcgccatgctgtcccacactgcgatcgaagtgtg

SEQ ID NO: 348807 - DNA, 2001 bp, Homo sapiens
gtaggtgggtgtggtgggagcctctgcaatcccagcattcccttcgtgccgctaccaagatggcggcgcccatcttgcggtccttttcctggggccggtggtctggtaccctaaatctctcagtattgttgcccttggggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtggggggtcacttccgcatggggacgctgctgagccggcagagcgtgcagctgcggctcaagagccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtgatgaaaagtccttctggttgtccaaataaacttacccatcattcattctcaagacctctgaagggttggctccagaacttagacctttgcttatgcaaatcagaaaaacagaatggactaggactcagtgtgagtaacttcattatttttatgggccggttaataaatatttgtttaataatgggatgttttattttctgatgtacaaagcttgattaccatagaaaaccatgattttcagggttaatctctttttaaaattatacttcagaagagaaagaaatgctgctttcctatcttacccttcctgctctcctttttgtagtgatgaggaacaatgaaaaagaggtagtgtaaggaattgtgaggctgggcatggtgtaagtgctccactttagagagtgtaccttaattactactgtatttgcaaattaagggaaatttaggtcatcatttgattttcggaaatctaaaaggaactgaccatcattaccaagtctttctatata

SEQ ID NO: 348808 - DNA, 2377 bp, Homo sapiens
gtaggtgggtgtggtgggagcctctgcaatcccagcattcccttcgtgccgctaccaagatggcggcgcccatcttgcggtccttttcctggggccggtggtctggtaccctaaatctctcagtattgttgcccttggggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtggggggtcacttccgcatggggacgctgctgagccggcagagcgtgcagctgcggctcaagagccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtgatgaaaagtccttctggttgtccaaataaacttacccatcattcattctcaagacctctgaagggttggctccagaacttagacctttgcttatgcaaatcagaaaaacagaatggactaggactcagtagatagggtctctttttttagcgccatctgcttgcagtgctgcctcttgctcctccccaccaccactgctgccctgagtcactgcctgcacagctccagccgcctggcttctcatagtagccactgatatttggagttcttacaacatggcagacattgacaacctgcctagctagggtagttaaaagaggagtgaatgctctcaaaaacctgcaagttaaaggtgcacagatagaagccaaattctatgaggaagttcacgatcttgaaaggaagtatgctgttctctatcagcctctatttgataagcaatctgagattactaatacaatttatgaacctacagaggaagaatgtgaatggaaaccagatgaagaagatgagatttcagaggagttgaaagaaaaggccaagactgaagatgagaaaaacgatgaagaaaaagaagaccccaaaggaattcctgaattttggttacctgtttttaagaatgttgacttgctcagtgatatgcttcagaaacatgatgaacctattctgaagcatgtgaaagataccaaagtgaagttctcagatgctggcctgcctatgagttttgtcttagaatttcaatttgaacccagtaaatattttacaaatgaagtgctgacaaagacatataggatgaggttagaaccagaaccagatgattctgatcacttttcctttgatggacaagaaattatgggttgtacagggggccagatagattggaaa

SEQ ID NO: 348809 - DNA, 2014 bp, Homo sapiens
  misc_feature (1987)..(1988): n is a, c, g, or t
gtaggtgggtgtggtgggagcctctgcaatcccagcattcccttcgtgccgctaccaagatggcggcgcccatcttgcggtccttttcctggggccggtggtctggtaccctaaatctctcagtattgttgcccttggggctgcgtaaggcccactcgggcgctcaggggttactggcagcgcagaaggctcgaggtctgttcaaggacttcttcccggagacggggacgaaaatagagctcccagagctcttcgaccgtggcacggcgagttttccccaaaccatttactgtggcttcgaccccacggcagactcgcttcatgtgggtcatctacttgcgctgctgggcctgtttcatttgcagcgagcgggccacaacgtgatcgcgctggtgggaggcgccacggcgcgcctgggagacccgagcggccgtaccaaggaacgcgaggcgctggagacagagcgcgtgcgagccaacgcgcgagctctgcgcctagggcttgaggccctggcggctaatcaccagcagcttttcactgatgggcgctcctggggcagcttcactgtgctggacaactcggcctggtaccagaagcagcacctggtggacttcctggcggcagtggggggtcacttccgcatggggacgctgctgagccggcagagcgtgcagctgcggctcaagagccccgagggcatgagcttggccgagttcttttaccaggtgctccaggcctatgacttctattacctcttccagcgttatggatgcagggtccagctgggcggatctgatcaactaggcaacatcatgtccggatatgagttcatcaacaagttgactggagaagatgtatttggaatcaccgttcctctaattacaagtacaactggagcaaagctgggaaagtctgctggcaacgctgtttggctaaacagagataagacatctccatttgaattgtatcaattctttgtcaggcaaccggacgattcagtggaaaggtacctgaagctgttcactttcctgccccttccagagattgatcatatcatgcagctgcatgtcaaagagccagaaaggcggggtcctcagaaacgactggcagcagaagtaacaaagcttgttcatggacgagaaggattggattctgctaaaaggtgtacacaagccctttatcacagtagcatagatgcactggaggtcatgtctgatcaggagttaaaagagttgtttaaagaagctccattttctgaattttttctcgatcctggaacaagtgtcctagatacttgccgcaaagcaaatgccattccagatggtccccgagggtatcgaatgataacagaaggcggagtcagcataaatcaccaacaagtaacaaatcctgagagtgttttaattgttggacaacatattctcaagaatggactttccttacttaaaataggaaaaagaaatttctacattataaaatggcttcagttgtgatgaaaagtccttctggttgtccaaataaacttacccatcattcattctcaagacctctgaagggttggctccagaacttagacctttgcttatgcaaatcagaaaaacagaatggactaggactcagtagatagggtctctttttttagcgccattgcctgcacagctccagccgcctggcttctcatagtagccactgatatttggagttcttacaacatggcagacattgacaacctgcctagctagggtagttaaaagaggagtgaatgctctcaaaaacctgcaagttaaaggtgcacagatagaagccaaattctatgaggagtccacactgaaccggagagtggtgcgtgactaacggcatgatcaccggggtggcgacctgaaacaaatgggaccatggcaattaaccgatgacccaaggttagaagatggaaggacacgagagacaatgcagagaagcaaacgaaatacctggtcccatactggcnngggacagaccccgcgcacaggggccc

SEQ ID NO: 348810 - DNA, 1535 bp, Homo sapiens
  misc_feature (147)..(147): n is a, c, g, or t
tcaggcccggtgcccagagcccaggaggaggcagtggccaggaaggcacaggcctgagaagtctgcggctgagctgggagcaaatcccccaccccctacctgggggacagggcaagtgagacctggtgagggtggctcagcaggcanggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaa

SEQ ID NO: 348811 - DNA, 1400 bp, Homo sapiens
tcaggcccggtgcccagagcccaggaggaggcagtggccaggaaggcacaggcctgagaagtctgcggctgagctgggagcaaatcccccaccccctacctgggggacaggtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaa

SEQ ID NO: 348812 - DNA, 1384 bp, Homo sapiens
  misc_feature (147)..(147): n is a, c, g, or t
tcaggcccggtgcccagagcccaggaggaggcagtggccaggaaggcacaggcctgagaagtctgcggctgagctgggagcaaatcccccaccccctacctgggggacagggcaagtgagacctggtgagggtggctcagcaggcanggaaggagaggtgtctgtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaa

SEQ ID NO: 348813 - DNA, 1778 bp, Homo sapiens
  misc_feature (147)..(147): n is a, c, g, or t
  misc_feature (1611)..(1611): n is a, c, g, or t
  misc_feature (1778)..(1778): n is a, c, g, or t
tcaggcccggtgcccagagcccaggaggaggcagtggccaggaaggcacaggcctgagaagtctgcggctgagctgggagcaaatcccccaccccctacctgggggacagggcaagtgagacctggtgagggtggctcagcaggcanggaaggagaggtgtctgtgcgtcctgcacccacatctttctctgtcccctccttgccctgtctggaggctgctagactcctatcttctgaattctatagtgcctgggtctcagcgcagtgccgatggtggcccgtccttgtggttcctctctacctggggaaataaggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaaacacaaaacaaaaaatcgggggctctaatggggggggggaaaagagttaggaaggccctgtcttagctggtccggnaccagttctgtccaagggggaatggcggtccttaaggagcgttacatcgtaacgtgcgattctctgggtgcgtgcgcagggagcgaaagggaaagcaaagatgaagcagcaacaaatagataacagaacgcagaccaggcgaagagagacaagagggaagcaaagan

SEQ ID NO: 348814 - DNA, 1332 bp, Homo sapiens
tcaggcccggtgcccagagcccaggaggaggcagtggccaggaaggcacaggcctgagaagtctgcggctgagctgggagcaaatcccccaccccctacctgggggacagggtgcagcggccatggctacagcaagacccccctggatgtgggtgctctgtgctctgatcacagccttgcttctgggggtcacagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaaagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaa

SEQ ID NO: 348815 - DNA, 427 bp, Homo sapiens
aggttgtactagtttacactccaccaacagtgtagaagtgttcgcttttcaccacatccactctaacatgtattttttttttattatggtcattcttgcgggagtgaggtggtatctcattgtggttttgatttgcatttccctgatcattagtgacgttgagcattttttcatgtcagccatttgtatatcttcttttgagaattatctgttcccatccttagcccactttttgatgggattgtttcgttcttgcggatttgagttctttgtagattctgggcattagtcctttgtcaggtgtatagattgtgaagattttctcccactctatgggttgcctgtttattttgctgattatgtctttcactgtgcagaagctttgtagtgtaattaagtcccatctatctttgttcttgttggattt

SEQ ID NO: 348816 - DNA, 711 bp, Homo sapiens
cattaatacaaaatcgacttctaatagcaagaagattgtaacttaataagaatattgacatatgcatgctttgttaatttatttgaattacatagatatgaacatgagagattttaagcatacattcttatatcatgttcttaaaatagattctattaaaattatgatctattatctatctatagtttaatctctttactatacaaaatataagctttcttgaaagcataataagtgagatttcgttaaattgacaacagtagtaggcagttctcagtgagcctaaggcagaaccttccttgtcaggtgaaacggtgctgctaaacatggagtgaccttcatagaagtcataaatatagtagcagctttctaaagtatagcatgtaatttaatcctttattaagtattgttaacaactttcataccctgtatttatttaaagcaacacttacaatctcaggcaatattattattaaccaatatgcctttaatattaaagtaagagatacttgtatatacaaacttcaaattctatgcataacatttcaaaaaccttgcaacattttaaaaatataatagattcatcaagctgtccaaattcatatagtgacaaataactgagattatgacccaaactttttatttttttattggttatattgttttattggtacactctacaactgttttgaaatagaatttgaatacgaa

SEQ ID NO: 348817 - DNA, 428 bp, Homo sapiens
  misc_feature (27)..(27): n is a, c, g, or t
ccacgagctcgtgccgaattcggcacnagtctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348818 - DNA, 2226 bp, Homo sapiens
ttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatcgtagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348819 - DNA, 881 bp, Homo sapiens
  misc_feature (763)..(763): n is a, c, g, or t
  misc_feature (768)..(768): n is a, c, g, or t
  misc_feature (774)..(774): n is a, c, g, or t
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccacaggcaatggtgaagcacgcacagccagngggcntgcggnaagacctgagaaacagcgactcggaaatccccgagcattccgtgtgacccgctggggctcgagggtcggtcgacactgacggggtatccgtgggaccgaaatgccat

SEQ ID NO: 348820 - DNA, 974 bp, Homo sapiens
caagagtgaaattggcagcagcagcctgttctgaacacctgtgggggtagggagaggttcccaacatctgtctcagctggaggatggggtcagggtcagagtgaatggctcagaccagaggcagaggccttttctttggcaaacaaagtgtgtcgtgctgtccatcctgcctcactggccagcggaacagaaagctgctgcccggctgggagctgggatctgataaggaaagttgtatcctgagagatttctctaggccaccagctaactaggacctaatagagcagtgtcgccagtgtttagccagtactgctggggtgtgctgtgtggcaccagccatcagcctggccagctctgctgggtgatgctgagatcacaacagtgagtcaaacttgggacccttgcagcttccactctggtgagggacagtgacaataggtggtaataaatatgattttggagttacacaggattctgggtggacaccagggaagggacacctgtgtataagaacgtgggaagccccatctgccacgcagagcaccatgaggatagggatcagatcttgaagctctctattctcaacatggagccaaacagaggatgagcccaataaaggttgaaagaatggcattgaggtgagagttctttcctttagcagggatttagagagcagctgctctgtgtgggcactgtgagttaatggtaggaggcatggttgggctgagtcagacttgccaaaggagaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348821 - DNA, 1654 bp, Homo sapiens
caagagtgaaattggcagcagcagcctgttctgaacacctgtgggggtagggagaggttcccaacatctgtctcagctggaggatggggtcagggtcagagtgaatggctcagaccagaggcagaggccttttctttggcaaacaaagtgtgtcgtgctgtccatcctgcctcactggccagcggaacagaaagctgctgcccggctgggagctgggatctgataaggaaagttgtatcctgagagatttctctaggccaccagctaactaggacctaatagagcagtgtcgccagtgtttagccagtactgctggggtgtgctgtgtggcaccagccatcagcctggccagctctgctgggtgatgctgagatcacaacagtgagtcaaacttgggacccttgcagcttccactctggtgagggacagtgacaataggtggtaataaatatgattttggagttacacaggattctgggtggacaccagggaagggacacctgtgtataagaacgtgggaagccccatctgccacgcagagcaccatgaggatagggatcagatcttgaagctctctattctcaacatggagccaaacagaggatgagcccaataaaggttgaaagaatggcattgaggtgagagttctttcctttagcagggatttagagagcagctgctctgtgtgggcactgtgagttaatggtaggaggcatggttgggctgagtcagacttgccaaaggagcaggcatgtatattgtagaccaggagggagaaggttctaggcagagagcaggaggtgcggaggcatgggggcatgagaaagcacaggatttgggagaccacagtagctctgtttaatggagtatgagtcctgggccaggcatggtgggcagtaagactacagagaaaaggacttcaggctacagggctgctttctgcgttgagaagctggggcttttcctggcagctttggggtaccctgttttctctgctttgccatggagccatattgggctcacatgtggtgccagggttctctgctttccacttataaggcagggctaggcagggccaggccgagcagaagatgtgaggccagctgctgagctgcgtgtacttggggaaggggggttggcaggacttgggtgccgcaagctgtaagtgaacctgatagctacattctgattgatggtggagtttgtctcccaaactgtcagagggtttatggaggtgccactcacccacaaggcgggaattgcttgtcaggacacctggccgtgtacaggagacagagctgtaacttggtgttttctcagcttaatggccctgctgctgacctgacctgcctgctgcctcaagtgtgtcagtgcctcagggtagagggcaaatgaggactgtcagggagaggtggattgcaggctgtgcctggcatctttccttcccgatgctgcttgcctttgggattggtggtgtctttgtgagaccagagactggtggggtagaagggagaaggatcaagactcagtgtttttcagggcttgaaaaatggagaacattccagatggagtgaatagcatgagcaggggtcttaagagcagcatatacaggctatgtttgtggtttggtgagcagcctgtgtgtgcacatgct

SEQ ID NO: 348822 - DNA, 526 bp, Homo sapiens
tggtttgtctttgctcactggatttttattaaacactgcaaatagaaaggtatgggtagaccttgcaccagctgcagccaaagagtggacttactcactggcttagttagcaccagtctcctccccaggtgctcttggcaaagcccagtccccaaaggagcaggaggtatttcaagatgagggccagatcaggcactgaataaaaaggccaatggctggcaagaggtcaggatgtgtcagctccactgggaccctgggggctgcagtgaccgtctgcttgttctgtgctttgttttcggtttccccgtgcagctcggattgggaaaatgaaacggaggaagcaagatgaagggcaggtatgtcccctgtgcaaccgccccctggcaggatcggagcaggagatgagtaggcatgtggagcattgcctttctaaggtagaggggccatcaccacccaccttccttcccgctcccttcccccgacactagctgctgactgcccctgaatctgtgggctcttggggtct

SEQ ID NO: 348823 - DNA, 2005 bp, Homo sapiens
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348824 - DNA, 2567 bp, Homo sapiens
tggggcgggggccaggactgcaggccgcgcctgacgctctcttttcttttcttgcatctgcccgcgatcttctcccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctggtgaggtggcatgggggtcggggaatgggaggccgctccgggcactgcccagatgtctgtgcttatgcctgagcctgcctgggggaagtggggagcatggcgcaaaggagaacagagccaggagccaggatatttacccgcaggatatttacccccaggctcgctgcctctcctccccaactgcaggtttaggaacttctccccctccatgagttcactgcattctcccttccccgccccggtccccgaaggcccactgcatcacacagactggtgaggcctggggtcaggaggaggctggctgtaggtaaacaggaccagggccttggcccctccccctcccattactaagctccttctgctcctgcccctgttcttcgctcaggagcagccattaaaatgtcgcccggagacagtaataaaaggctcggacgtgggctctgtgtcctgatcaaaggccgcgtgtaatctcgttagggctgcggctgccacagctggacccagccttgttctcattactggggctcctgctgcggggctggccaggcggtttgatcctggcgtccccccaacacaggagcgtgcctgcctgctcacagaagctgcctatgcgtccccagcctgggctgacaggaccaaggtctcagcacacactggtgcagagagacatggctgcaggcccaggtgctcacatgcgcacacatggctcattgtgtagaccagagccctccctgttctccctgcagggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348825 - DNA, 2049 bp, Homo sapiens
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttaaaaaaaaaaaaaaaatccgagggctccatgcgggggggggaaa

SEQ ID NO: 348826 - DNA, 2012 bp, Homo sapiens
tggtttgtctttgctcactggatttttattaaacactgcaaatagaaaggtatgggtagaccttgcaccagctgcagccaaagagtggacttactcactggcttagttagcaccagtctcctccccaggtgctcttggcaaagcccagtccccaaaggagcaggaggtatttcaagatgagggccagatcaggcactgaataaaaaggccaatggctggcaagaggtcaggatgtgtcagctccactgggaccctgggggctgcagtgaccgtctgcttgttctgtgctttgttttcggtttccccgtgcagctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348827 - DNA, 2304 bp, Homo sapiens
ttaagaactgccatgacacagagtctccccacttgcgcttctcagatgcagatggcaaggaatatgactttgggacacagctgccatctagctcccccggttcactaaaggttgatgacactgggaagaagatttttgctgtctctggcctcatttctgatcgggaagcctcatcgtagcccagaggatcggaatgacagatgtaagaagaaagcagcggcattgttcgacagccaggccccaatttgccccatctgccaggtcctgctgaggcccagtgagctgcaggagcatatggagcaggaactggagcagctagcccaactgccctcgagcaagaattcccttctgaaggatgccatggctccaggcaccccaaagtccctcctgttgtctgcttccatcaagagggaaggagagtctccaacggcatcaccccactcatctgccaccgatgacctccaccattcagacagataccagacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348828 - DNA, 1591 bp, Homo sapiens
aaaagccacgctggtacggccctggatgttaaggatcgggccaccactctcctggaaggtggcttccggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348829 - DNA, 1613 bp, Homo sapiens
tcccgggtgcatgatgtggaatcgagtgagataagtttgaggagttgagtgtgtgaagaagggatagggcacatctctggaagtggttcggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348830 - DNA, 1818 bp, Homo sapiens
gatgcacctcaggggtcagccacttgcgtggcccatggcctggcctccgctcagcctggttgccttcatggactgctttgagaagtaggtgtgcatgcctgtcctccctcgtctgtcccttcttaatccctttataactgcacttgtccaggaatctgggctgagtgaggtggagatgaataattaatgtcaggcgcttcagacaccaaatatttgaacagctgcctggtgtttttgctggcaaggacctagcggccaaaatcaggatgttggccgggggtcccactctgtggctctgattggccttagccagcctgttctctcctctgatggacttgtcaggctggataatggggcataggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348831 - DNA, 2040 bp, Homo sapiens
tggtttgtctttgctcactggatttttattaaacactgcaaatagaaaggtatgggtagaccttgcaccagctgcagccaaagagtggacttactcactggcttagttagcaccagtctcctccccaggtgctcttggcaaagcccagtccccaaaggagcaggaggtatttcaagatgagggccagatcaggcactgaataaaaaggccaatggctggcaagaggtcaggatgtgtcagctccactgggaccctgggggctgcagtgaccgtctgcttgttctgtgctttgttttcggtttccccgtgcagctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348832 - DNA, 1511 bp, Homo sapiens
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaaaggtacttgtcctttccctttgtaaactacatttgacatggattaaaccagtataaacagtt

SEQ ID NO: 348833 - DNA, 1504 bp, Homo sapiens
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcaggagttgcgtggggcgctatgggccgggctagatccccctatggggcggcgccgcttgcgccgcacgcttgttacgggtggccgtgtgcgtggcacctcgcactgtccctgtggttccttaaccgcggcttgtgggggcactggtgtctcggctccaggggtgtccagctcgcactcgtaagg

SEQ ID NO: 348834 - DNA, 377 bp, Homo sapiens
cttctgaaggatgccatggctccaggcaccccaaaggtaggtggccaattacatgttttcctcctgcccatactaacctaggcctacccagaactggttcctcctgagaaaaaggagcttttctagtatcctcaactatctccagcttttctaatatcctcaactatctccaggtcttgaacatcatcctgaggcctagggctgcgccgtgtgtgtgtgtaagtgtgtgtggtctgtgcatgagtgagagtatgctcatctgacttcctcctcttccagccaggagaggggtcagagccaagaatggcctgggagatgtgggtgacccagacactaagggtgagaagactcaaaggaagaaagtgagctatagcaga

SEQ ID NO: 348835 - DNA, 1161 bp, Homo sapiens
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtaacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaatcaccgacgaattcaaggctgttaaccaccgcatcggaggcgcctctgaaacggggctcggggctaacagaagcaaccctttagcacggcgcacctactctctcgtgggcaccgcgtacaacaggtgcgcaacgctaggcatgggcctcgacaacatgaagtagcccataaggtcatcctcagcgtttgtcacgtgcaccatccagcagctacactgcgttgtagtcccccgttgtcgccaaacagcgaccacgagtacacagtacagtcagcgcgcagtc

SEQ ID NO: 348836 - DNA, 979 bp, Homo sapiens
gggtaccccccttgcgtgttcatagggaaggctcctgcatggctgaggatgatgctgtggacatcgagcatgagaacaacaaccgctttgaggagtatgagtggtgtggacagaagcggatacgggccaccactctcctggaaggtggcttccgaggtacaagcagctgacacgtagacattggcactctggtgccaggcctctgctgggtatccatctgctggaagccaagaggccgaggctggtggctggtcatccatccgttccaccacgtggggactgctgctggtggggctcctttgtgaccgtgctgcctgcctgtgatgtgcatattaaaatggatgtatttgggtggggaaatggaattgtgaggctgcaagctaggagtgacgaaggggggctctcagcttcgggtgatgcattgaaggtgacagccaagccgcgttagcacctgcataaaatattaaagggacggttatgcatttatcactccatccctcttaaggctgataaatgagaatccagcaacctgctgtacacctccagcactgggggccctgagggcttccaggcaaacacattggattttcctcctcctcctcttcagccctatgtcagggaaatcagttacagaggagagtgagttatggcaaaatttgacctcccatgagcttcattggtgaatctaattttagctctgatcccatcccttctccctgggcgccctctgccctgaagcaagaggggcctgggcccagctgctccctccttcccttgggctctccccagttgctacaaaggagtgtgcagggccctgcccatctccagtgccctcccagctccttggaagagcaaggcttgacaccccccaccaggtcagacagcagaattggttgggtgcccagggttagtgacttgttaaactccccagccttgggcaggggaaaaggggagctgtctgcctcttggcctccagctc

SEQ ID NO: 348837 - DNA, 2775 bp, Homo sapiens
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtacatctgcccgcgatcttctcccagacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctggtgaggtggcatgggggtcggggaatgggaggccgctccgggcactgcccagatgtctgtgcttatgcctgagcctgcctgggggaagtggggagcatggcgcaaaggagaacagagccaggagccaggatatttacccgcaggatatttacccccaggctcgctgcctctcctccccaactgcaggtttaggaacttctccccctccatgagttcactgcattctcccttccccgccccggtccccgaaggcccactgcatcacacagactggtgaggcctggggtcaggaggaggctggctgtaggtaaacaggaccagggccttggcccctccccctcccattactaagctccttctgctcctgcccctgttcttcgctcaggagcagccattaaaatgtcgcccggagacagtaataaaaggctcggacgtgggctctgtgtcctgatcaaaggccgcgtgtaatctcgttagggctgcggctgccacagctggacccagccttgttctcattactggggctcctgctgcggggctggccaggcggtttgatcctggcgtccccccaacacaggagcgtgcctgcctgctcacagaagctgcctatgcgtccccagcctgggctgacaggaccaaggtctcagcacacactggtgcagagagacatggctgcaggcccaggtgctcacatgcgcacacatggctcattgtgtagaccagagccctccctgttctccctgcagggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348838 - DNA, 2083 bp, Homo sapiens
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtaacctttctgcgagtacgagccaaccggcagacccgactgaatgctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348839 - DNA, 2090 bp, Homo sapiens
tggtttgtctttgctcactggatttttattaaacactgcaaatagaaaggtatgggtagaccttgcaccagctgcagccaaagagtggacttactcactggcttagttagcaccagtctcctccccaggtgctcttggcaaagcccagtccccaaaggagcaggaggtatttcaagatgagggccagatcaggcactgaataaaaaggccaatggctggcaagaggtcaggatgtgtcagctccactgggaccctgggggctgcagtgaccgtctgcttgttctgtgctttgttttcggtttccccgtgcagctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348840 - DNA, 1643 bp, Homo sapiens
ggtgaccttttcaggaggaattagattgcctgccaagaccggttagagggagtgataacgccagctgaagaagctgcccagcagacttcagagagaaggaggcagaggcaggatgagcaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348841 - DNA, 1605 bp, Homo sapiens
gttgtttggttgagttgagacacaacggtgaggagtgagtgggtggagaacggtacggcacactctcctggaagtgggtgcggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348842 - DNA, 2194 bp, Homo sapiens
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagacagacatgcaaacaccagactgaagcacatgtaatatagaccgtgtatgtttacaatgttgtgtataaatgggacaactcctcgccctctacctgtcccctccccctttggttgtatgattttcttcttttttaagaacccctggaagcagcgcctccttcagggttggctgggagctcggcccatccacctcttggggtacctgcctctctctctcctgtggtgtcccttccctctcccatgtgctcggtgttcagtggtgtatatttcttctcccagacatggggcacacgccccaagggacatgatcctctccttagtcttagctcatggggctctttataaggagttggggggtagaggcaggaaatgggaaccgagctgaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagttaaaaaaaacaaaaaaaaacttccgaagggcctcaaaatacacggagcgtgcggacaacacacggactcggcaaggcgaccaggggcccaaagaggatacatggaccacactatcccgggacaaaggcgacactcgcccgaccccctatagagagcccaatcaatcagaaagcccaggaaactcataata

SEQ ID NO: 348843 - DNA, 1621 bp, Homo sapiens
ggcggcagatcacgtgattagggccaacatggccgccgccgccgcttggagctgaagtgccgccgccgccgggcagccacggggaatccgcccgcatcgccgccctcgccggccgggcggccgtggggcccagagcgccggaggccagggctggggcggcaccgcgcagcggccacggggtcccgttagagcagcgcccggcggctatgccgagagcccggagcggccggaggagcagaggggccggcgggagggaggagtaacctttctgcgagtacgagccaaccggcagacccgactgaatgctcggattgggaaaatgaaacggaggaagcaagatgaagggcagagggaaggctcctgcatggctgaggatgatgctgtggacatcgagcatgagaacaacaaccgctttgaggagtatgagtggtgtggacagaagcggatacgggccaccactctcctggaaggtggcttccgaggctctggcttcatcatgtgcagcggcaaagagaacccggacagtgatgctgacttggatgtggatggggatgacactctggagtatgggaagccacaatacacagaggctgatgtcatcccctgcacaggcgaggagcctggtgaagccaaggagagagaggcacttcggggcgcagtcctaaatggcggccctcccagcacgcgcatcacacctgagttctctaaatgggccagtgatgagatgccatccaccagcaatggtgaaagcagcaagcaggaggccatgcagaagacctgcaagaacagcgacatcgagaaaatcaccgaagattcagctgtgaccacgtttgaggctctgaaggctcgggtcagagaacttgaacggcagctatctcgtggggaccgttacaaatgcctcatctgcatggactcgtactcgatgcccctaacgtccatccagtgttggcacgtgcactgcgaggagtgctggctgcggaccctgggtgccaagaagctctgccctcagtgcaacacgatcacagcgcccggagacctgcggaggatctacttgtgagctatctgccccaggcaggcctcgcctccagcagccccacctgcccccagcctctgtgacagtgaccgtctccctttgtacatacttgcacacaggttccccatgtacatacatgcacatactcaaacatgcgtacacacacacacatttacacacgcaggactctggagccagagtagaggctgtggcccaggcactacctgctggctcccacctatggtttgggggccatacctgttccagctctgttcccagggtggggcagggaggtgggggttgggggagtagtggggcacggctcctaagatccagcccccatactgacagacggacagaaagcagaggctgagttagggggctagaggacagtgctcctggccacccagcctctgctgagaaccattcctgggattagagctgcctttcccagggaaaaagtgtcgtctccccgaccctcccgtgggccctgtggtgtgatgctgtgtctgtatattctatacaaaggtacttgtcctttccctttgtaaactacatttgacatggattaaaccagtataaacagtt

SEQ ID NO: 348844 - DNA, 1390 bp, Homo sapiens
tggtttgtctttgctcactggatttttattaaacactgcaaatagaaaggtatgggtagaccttgcaccagctgcagccaaagagtggacttactcactggcttagttagcaccagtctcctccccaggtgctcttggcaaagcccagtccccaaaggagcaggaggtatttcaagatgagggccagatcaggcactgaataaaaaggccaatggctggcaagaggtcaggatgtgtcagctccactgggaccctgggggctgcagtgaccgtctgcttgttctgtgctttgttttcggtttccccgtgcagctcggattgggaaaatgaaacggaggaagcaagatgaagggcaggtatgtcccctgtgcaaccgccccctggcaggatcggagcaggagatgagtaggcatgtggagcattgcctttctaagagggaaggctcctgcatggctgaggatgatgctgtggacatcgagcatgagaacaacaaccgctttgaggagtatgagtggtgtggacagaagcggatacgggccaccactctcctggaaggtggcttccgaggtacaagcagctgacacgtagacattggcactctggtgccaggcctctgctgggtatccatctgctggaagccaagaggccgaggctggtggctggtcatccatccgttccaccacgtggggactgctgctggtggggctcctttgtgaccgtgctgcctgcctgtgatgtgcatattaaaatggatgtatttgggtggggaaatggaattgtgaggctgcaagctaggagtgacgaaggggggctctcagcttcgggtgatgcattgaaggtgacagccaagccgcgttagcacctgcataaaatattaaagggacggttatgcatttatcactccatccctcttaaggctgataaatgagaatccagcaacctgctgtacacctccagcactgggggccctgagggcttccaggcaaacacattggattttcctcctcctcctcttcagccctatgtcagggaaatcagttacagaggagagtgagttatggcaaaatttgacctcccatgagcttcattggtgaatctaattttagctctgatcccatcccttctccctgggcgccctctgccctgaagcaagaggggcctgggcccagctgctccctccttcccttgggctctccccagttgctacaaaggagtgtgcagggccctgcccatctccagtgccctcccagctccttggaagagcaaggcttgacaccccccaccaggtcagacagcagaattggttgggtgcccagggttagtgacttgttaaactccccagccttgggcaggggaaaaggggagctgtctgcctcttggcctccagctc

SEQ ID NO: 348845 - DNA, 2607 bp, Homo sapiens
aggctcctagtcccgcctccaggccccttcccgcgtcgcgacgcacgctgccccggaaggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatattacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 348846 - DNA, 1970 bp, Homo sapiens
aggctcctagtcccgcctccaggccccttcccgcgtcgcgacgcacgctgccccggaaggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatattacagatcaacagcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattg

SEQ ID NO: 348847 - DNA, 2557 bp, Homo sapiens
tcatcgctgtctggaacagcgatgactgagtgcggcgccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatattacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 348848 - DNA, 2444 bp, Homo sapiens
aggctcctagtcccgcctccaggccccttcccgcgtcgcgacgcacgctgccccggaaggccgcggcgctgtagtgcggcgtgggagccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatattacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 348849 - DNA, 3275 bp, Homo sapiens
tgtgttgaaggtcagtgcttcactaggagggctcacaggactcagaatatagtgtacttacagctatgatttattacagtgaagggaaataaagcaaaatcagcaaagggaaaaagcatattgggggaaatcaggtacaaacttctgagttctctcccagtggagttacgtaggatatgcttaattcctccagcaaccagctatgacaacatgtttgaagtgttgtctaccaaggaagctcaactagacactcagtgatcagaatttttattggaggatggccacataggcaccctctgtataggtactctcgactggcatgtaccagaattctaagactcctggaaggaaggcgggtattcagcatgaaccacattgtttttcataaacagttttaggcacagggagccactcttaccagagaatggcagaaaccctcctgaaatctaagttctagatgccagtcaaaggccaaccttgtaagcacacctttgaaagtatagtagtcttaggcctgtcatgttagctcttttttgcagttcttcttgtgtgattaaaggaagttaattcctatcctagaattattgtgcagattagagagagaatgtgaagctcctatcacagttcctgactcttagtgagtgcacaataaacaatacctgctatagctgttacatgtgaggtataggaatcttgagctcttttacactggttagaaaaaccagttttctataaggaagaaatgaaaaaatctacattctgcctctcaaacaaggcaagaaaagctgtttttatttatattgaaattatatttcaaacattatttaggtagtgaacatttcctggctttttgacctttattctctgattctgttaaaatataggtaataagagaaatgaagccaacaggtacagacccaaggatcttatctatagctgctgaagttgcaaaaagccctgagcagaatgtccctgttatactgttgaagttaaaagaaataataaacatcacacctttaggaagctcagagttgaagaaaatcaaacaagatatatattgttatgatctcattcaatattgcctcttggtcctcagtcaagattattctcgaatccagggtggttggactacaatttcccagcttacacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatattacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 348850 - DNA, 2301 bp, Homo sapiens
tcatcgctgtctggaacagcgatgactgagtgcggcgccccaggttctttagtggaagaacgcgaagcgaggatgagtgatccgtggaggcagtaacaggcgcggcgagggagaagtgattcccgaagaatcaaggctgggccggacccggtggcctggcaacagggtaataagagaaatgaagccaacaggtacagacccaaggatcttatctatagctgctgaagttgcaaaaagccctgagcagaatgtccctgttatactgttgaagttaaaagccattgctgtgtgggcttggagccaggagaagatgcagaggaattttacaatgaattacttccatcagctgcagaaaattttctagttttggggagacaattacaaacatgttttatcaatgcagctaaggtactacaaagtgatcatttcttacatttactgcaagctgacaatgtccaaataggatctgcagtcatgatgatgctacagaatatattacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 348851 - DNA, 2305 bp, Homo sapiens
tttgtagcagtacttcttataactggactaggagttgaaaaaagcttgaaaataacttcatctaaaattgaatacagggcttttcttcctattctgagtaaatcaccactgttgatctgtaatatattctgtagcatcatcatgactgcagatcctatttggacattgtcagcttgcacagatattaagccattgctgtgtgggcttggagccaggagaagatgcagaggaattttacaatgaattacttccatcagctgcagaaaattttctagttttggggagacaattacaaacatgttttatcaatgcagctaaggctgaagaaaaagatgaattactacactttttccaaattgtgactgattctctcttctggcttttgggaggccatgttgaacttattcagaatgtactacaaagtgatcatttcttacatttactgcaagctgacaatgtccaaataggatctgcagtcatgatgatgctacagaatatattacagatcaacagtggtgatttactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgattatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacat

SEQ ID NO: 348852 - DNA, 323 bp, Homo sapiens
attccatagcctcctcagccaaaaacaccctctttagcaccagtctttagtcttcttggtatgtttctatttcctttgttactcttattttcatattctttccaactactgagataacttgaaggaatgaatttgaagctttagtgtgtccctcataacatcgcacacatattaatagcatacaaccaaacagcctagaatagaatgaaaagtttcaattaagtatgttaagtcactaaaaactaatacatgaaatatgcaactctgacattattcgaaaatcacgttgcatcctaacaaccagtttctactgcaatgcaaca

SEQ ID NO: 348853 - DNA, 603 bp, Homo sapiens
aaaggagtaaatgagtaatatgcatttttggacaaagaggtcgaaacctttgtggaacacaactttcaagatggagatatatattcacgaagctttattgcagctgtttcccttacccagttgaagtggccagtcattttaatttgcagttctatttacattcccaaggtaaccacgttcagtaactctctagaggctaagctgttaaaatttccatttttatacaaatagcaaagatatttctttctctttctttctttctttctttctttctttctttcttttctttctctctttccttccttccttctttcttttctttctctctttccttccttccttccctccttccttctttcttctctttccttctttcttttacaatggtccttatgctggactcatttatcttgaaatggtgggcaacacagaccccaatctatggtatcaagcaactcaactttttcttgtaatgtcatgactcttctgtgcttcttgggagcacttctatgactggtggtgcttcatatgggtcctgcagtttttatgtcctcaaggtttacagtattgcactaaccatgaaaaatatgcaagaaccgcaag

SEQ ID NO: 348854 - DNA, 886 bp, Homo sapiens
  misc_feature (185)..(185): n is a, c, g, or t
  misc_feature (192)..(192): n is a, c, g, or t
  misc_feature (198)..(198): n is a, c, g, or t
  misc_feature (200)..(200): n is a, c, g, or t
  misc_feature (204)..(204): n is a, c, g, or t
agagagggaaccgcaaggggcccactgtacaaatgcaatcgccgggccaaggtaaatggtgaacgccactccactagggtgaaattggccaagtgaacttgatatagggccccaatttaaaaggtaggtgacggcaaaagtctattgggaaagatctgcaagtattttttttaatataatatttnttttttntttttnantttnttttttttttttttttttttttttttttttttttattcacattgggtcatctttaaaaagctggactctgcttttggatgcttctcggaggcgagttggattttggactgaagtactgtcgttccattcctttttttgaggtgttatgagtggggctataacatcgccatcctattaggaagagagagaaaaacaggcaatagagaaaagccagtttccatcatcttatttctgagtgaaagtctcaagtgcgcacatcctcatcttgcatatagattgcttctagctgtcctcaatccagggaaactccaaattacatatgccctgtgcttggggcaaattagaaacactacagtcttacgcaggaagagccttcatgaaaacagccactggcctctgcagagatgactgggagcagcataccactgcccacctctatggctccttcacacaccttcacggagcacaaactctgtcctgttttcccaggagaaagacgggatgcactgaacccctagcttctctctcgcctggtcccctctgcaataaaaggcccaggtctacaagatggcaaagaaggggaggaagaacagtatgtacctgcagaatttaaatttttctctgcatcaaagctctaacgttggtcccatcagcataggctccagccaaagaagctcctcca

SEQ ID NO: 348855 - DNA, 298 bp, Homo sapiens
tcggcaactgcttcggatgtcggcaactgcttcggatgccatggcggagagcgatgttcttggtgaattgctatagaactgggaatgaggtgtgccctgggcacaggggcactgccccaccaaggtggtgcccactccactgctgggaaaacgaagttacctagcggagcctggagcccactgggtggtcactaatttcagcacaggcagtgcagtgtttgtgcttttttttttggagatggagtctcactctgtcacccaggctggagtgcaatggcgtgatctaggctcactgcaa

SEQ ID NO: 348856 - DNA, 1631 bp, Homo sapiens
aaaggagtaaatgagtaatatgcatttttggacaaagaggtcgaaacctttgtggaacacaactttcaagatggagatatatattcacgaagctttattgcagctgtttcccttacccagttgaagtggccagtcattttaatttgcagttctatttacattcccaaggtaaccacgttcagtaactctctagaggctaagctgttaaaatttccatttttatacaaatagcaaagatatttctttctctttctttctttctttctttctttctttctttcttttctttctctctttccttccttccttccctccttccttccttcctttctttctttttgtttgagacagagtttcgctcttgaccccgaggctggagtgcagtggcctgatcttggctcactgcaacctctgcctcccggattcaagcgattctcctgcctcagcctcccgagtagctgggattacaagcacacaccaccacgcccggctaatttcacccggctaatttttgtatttttagtagagactgggtttcgccatgctagccaggctggtctcaactctttacctcaagtgatccgcccaccttggcctcccaaagtgctgggattacaggcatgaccacctcgcctggccaagaaaaatgtaaccttgtaaatagcacagcgttctcataatggaaacagttgcaaagaacataaagtacagctgcgttacatgtaacaaaagatgcaaacaaaatagattcaagttgttttgcagacagcacaatgatacaatattaggactacagaatctcagagtaaaccacaatgatttaaaggtaagatacacagaaataaaatgattttaacagaaaaatatgacattcctgaccttaggtctgggcacatgatgtctgacccctatagaggcaccttggctaaaatgggaatgacctagtgccatggctgacctcacttgtgcgttgctgagcccatatgtgaacaaatccccttgatacagcaccatggtaggcatgagaggagaagtgttttaactattctcttatgaattgtaaccaacccttattatctactgatggatggacagggggtggggtgatcatacaggatggcagacattccaagtactcttcaccccagtgtggacggaacagaatctggctacacggtggccagtgatggactgctgggaaatctgctggcctgtggtctgagttcccctacttgctcaggctgcccctcactcccagtgtgccagggaggcttagtccggggagcatcagagcagaagacattcggggctcatggctcccatccccactggcctgtatcttcagcaccctctggccaccaccagctttggctctaactgcagactttgttcttggtgaattgctatagaactgggaatgaggtgtgccctgggcacaggggcactgccccaccaaggtggtgcccactccactgctgggaaaacgaagttacctagcggagcctggagcccactgggtggtcactaatttcagcacaggcagtgcagtgtttgtgcttttttttttggagatggagtctcactctgtcacccaggctggagtgcaatggcgtgatctaggctcactgcaa

SEQ ID NO: 348857 - DNA, 1447 bp, Homo sapiens
  misc_feature (467)..(467): n is a, c, g, or t
  misc_feature (474)..(474): n is a, c, g, or t
  misc_feature (480)..(480): n is a, c, g, or t
  misc_feature (482)..(482): n is a, c, g, or t
  misc_feature (486)..(486): n is a, c, g, or t
ttaaaagggggaaacccatgcccctttcggggactccttttgtgtaaaggggttttccccgattggccattggtgtaaaaaaagagtggtttacaaaattttaccggggttttttcaaaaatttgggcgccaaatatttcatttcccccgaaggatcggccaacatttggaaaaggtcaaccaggggggcacttttgttttcctccacccttcaaataggggtttcttctagaacggtttaatttggggaaccccagggttttgcctaccacccttttttaaaaaccggccctttttatttgtataaggccccgcaagggggcatttcccaaaaggtcccacttttgtccccgcagagtaaaaattcatgatcttaaaaaaccgatgggccaaagggcccctgatattttttttatgttcttgtctctttttttattttgttgtttttttttttttttttttttttnttttttntttttnantttntttttttttttttttttttttttttttttttttttttttttttttttttttttttttttttttttttttttttttagattcaagttgttttgcagacagcacaatgatacaatattaggactacagaatctcagagtaaaccacaatgatttaaaggtaagatacacagaaataaaatgattttaacagaaaaatatgacattcctgaccttaggtctgggcacatgatgtctgacccctatagaggcaccttggctaaaatgggaatgacctagtgccatggctgacctcacttgtgcgttgctgagcccatatgtgaacaaatccccttgatacagcaccatggtaggcatgagaggagaagtgttttaactattctcttatgaattgtaaccaacccttattatctactgatggatggacagggggtggggtgatcatacaggatggcagacattccaagtactcttcaccccagtgtggacggaacagaatctggctacacggtggccagtgatggactgctgggaaatctgctggcctgtggtctgagttcccctacttgctcaggctgcccctcactcccagtgtgccagggaggcttagtccggggagcatcagagcagaagacattcggggctcatggctcccatccccactggcctgtatcttcagcaccctctggccaccaccagctttggctctaactgcagactttgttcttggtgaattgctatagaactgggaatgaggtgtgccctgggcacaggggcactgccccaccaaggtggtgcccactccactgctgggaaaacgaagttacctagcggagcctggagcccactgggtggtcactaatttcagcacaggcagtgcagtgtttgtgcttttttttttggagatggagtctcactctgtcacccaggctggagtgcaatggcgtgatctaggctcactgcaa

SEQ ID NO: 348858 - DNA, 810 bp, Homo sapiens
  misc_feature (467)..(467): n is a, c, g, or t
  misc_feature (474)..(474): n is a, c, g, or t
  misc_feature (480)..(480): n is a, c, g, or t
  misc_feature (482)..(482): n is a, c, g, or t
  misc_feature (486)..(486): n is a, c, g, or t
ttaaaagggggaaacccatgcccctttcggggactccttttgtgtaaaggggttttccccgattggccattggtgtaaaaaaagagtggtttacaaaattttaccggggttttttcaaaaatttgggcgccaaatatttcatttcccccgaaggatcggccaacatttggaaaaggtcaaccaggggggcacttttgttttcctccacccttcaaataggggtttcttctagaacggtttaatttggggaaccccagggttttgcctaccacccttttttaaaaaccggccctttttatttgtataaggccccgcaagggggcatttcccaaaaggtcccacttttgtccccgcagagtaaaaattcatgatcttaaaaaaccgatgggccaaagggcccctgatattttttttatgttcttgtctctttttttattttgttgtttttttttttttttttttttttnttttttntttttnantttntttttttttttttttttttttttttttttttttttttttttttttttttttttttttttttttttttttttttttagattcaagttgttttgcagacagcacaatgatacaatattaggactacagaatctcagagtaaaccacaatgatttaaaggtaagatacacagaaataaaatgattttaacagaaaaatatgacattcctgaccttaggtctgggcacatgatgtctgacccctatagaggcaccttggctaaaatgggaatgacctagtgccatggctgacctcacttggttacatattacgatgggatcctctagt

SEQ ID NO: 348859 - DNA, 1158 bp, Homo sapiens
atccctggagtctggtcttctgcacgtcaagggacggtttcagcctgcagagcctgtaccggcggatggagggctgcagcgggccagtgctgctggtgctcagggaccaggacgggcagatatttggagccttctcctcctcggctatccgactcagcaaaggcttctatggtactggcgagacattcctcttctccttctccccacagctgaaggtctttaagtggactggaagcaactctttctttgtgaagggagacttggattcactgatgatgggcagtggcagtggccggtttgggctgtggttggatggagacttgttccgcgggggaagctccccttgcccgaccttcaacaacgaggtgctggcccggcaggagcagttctgcatccaggagctggaggcttggcttctcagctgacagccctgcggcaacagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgtcgttccattcctttttttgaggtgttatgagtggggctataacatcgccatcctattaggaagagagagaaaaacaggcaatagagaaaagccagtttccatcatcttatttctgagtgaaagtctcaagtgcgcacatcctcatcttgcatatagattgcttctagctgtcctcaatccagggaaactccaaattacatatgccctgtgcttggggcaaattagaaacactacagtcttacgcaggaagagccttcatgaaaacagccactggcctctgcagagatgactgggagcagcataccactgcccacctctatggctccttcacacaccttcacggagcacaaactctgtcctgttttcccaggagaaagacgggatgcactgaacccctagcttctctctcgcctggtcccctctgcaataaaaggcccaggtctacaagatggcaaagaaggggaggaagaacagtatgtacctgcagaatttaaatttttctctgcatcaaagctctaacgttggtcccatcagcataggctccagccaaagaagctcctcca

SEQ ID NO: 348860 - DNA, 910 bp, Homo sapiens
atccctggagtctggtcttctgcacgtcaagggacggtttcagcctgcagagcctgtaccggcggatggagggctgcagcgggccagtgctgctggtgctcagggaccaggacgggcagatatttggagccttctcctcctcggctatccgactcagcaaaggcttctatggtactggcgagacattcctcttctccttctccccacagctgaaggtctttaagtggactggaagcaactctttctttgtgaagggagacttggattcactgatgatgggcagtggcagtggccggtttgggctgtggttggatggagacttgttccgcgggggaagctccccttgcccgaccttcaacaacgaggtgctggcccggcaggagcagttctgcatccaggagctggaggcttggcttctcagctgacagccctgcggcaacaggtactcagccctgctcatgatgccacccaggccttcctgacacacagcagcctgtgctgtttgaaacacagatggtgaagggccctagagttggccgaggctgctggccagcctccttgtggcctggggacccaagatacaggtgggggcaggcactgctcttttgcagaggtgactttgaaggattaaaagacgcttacaccttactcaagcagcacagagaccctaagctaacagggtcttagaaaactcagaaaaatccacatctcttccccgctagtgcctgcctcctggcaaagggaagatttttcactatgctgttcctcgccagctactgaacgaggaaaaccaacctcatgaacattatcattttagaggttctacaactgattcatgtttattgtagaaaaaccagaagacgttaaaaaaattaaaattgcctaaaattcaaccccccccaactcttaa

SEQ ID NO: 348861 - DNA, 1005 bp, Homo sapiens
atccctggagtctggtcttctgcacgtcaagggacggtttcagcctgcagagcctgtaccggcggatggagggctgcagcgggccagtgctgctggtgctcagggaccaggacgggcagatatttggagccttctcctcctcggctatccgactcagcaaaggcttctatggtactggcgagacattcctcttctccttctccccacagctgaaggtctttaagtggactggaagcaactctttctttgtgaagggagacttggattcactgatgatgggcagtggcagaattctatgattgaagcctctaaatgaattgtgcaggagagggagtttgtaaacaactgactacagacattcacattgggtcatctttaaaaagctggactctgcttttggatgcttctcggaggcgagttggattttggactgaagtactgtcgttccattcctttttttgaggtgttatgagtggggctataacatcgccatcctattaggaagagagagaaaaacaggcaatagagaaaagccagtttccatcatcttatttctgagtgaaagtctcaagtgcgcacatcctcatcttgcatatagattgcttctagctgtcctcaatccagggaaactccaaattacatatgccctgtgcttggggcaaattagaaacactacagtcttacgcaggaagagccttcatgaaaacagccactggcctctgcagagatgactgggagcagcataccactgcccacctctatggctccttcacacaccttcacggagcacaaactctgtcctgttttcccaggagaaagacgggatgcactgaacccctagcttctctctcgcctggtcccctctgcaataaaaggcccaggtctacaagatggcaaagaaggggaggaagaacagtatgtacctgcagaatttaaatttttctctgcatcaaagctctaacgttggtcccatcagcataggctccagccaaagaagctcctcca

SEQ ID NO: 348862 - DNA, 724 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctga

SEQ ID NO: 348863 - DNA, 4124 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttggagacggagtcttgttctgttgccaggctggagtgcggtggtgcaatctcagctcactgcaatctccacctccgtgggttcaagaggttctcctgcctcagcctcctgagtagccggggagctacaagcttgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacgcctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgc

SEQ ID NO: 348864 - DNA, 4206 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttggagacggagtcttgttctgttgccaggctggagtgcggtggtgcaatctcagctcaggatggcggatcgcttgagcacgggagttcgagaccagcctgagcaacttggtgcaaccccgtccctacaaaaaacacaaaaaatagcggggcgtggtggtgcggaccggtggttctcctgcctcagcctcctgagtagccggggagctacaagcttgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacgcctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgc

SEQ ID NO: 348865 - DNA, 3680 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttggagacggagtcttgttctgttgccaggctggagtgcggtggtgcaatctcagctcactgcaatctccacctccgtgggttcaagaggttctcctgcctcagcctcctgagtagccggggagctacaagcttgcaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacgcctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgc

SEQ ID NO: 348866 - DNA, 4058 bp, Homo sapiens
ggggagagctctcccaggcgcgatggaggcaacccgaacctgaagcagccacactgccttacatttgatccttctctcagttttttccccacttaatcaccgctgaaaaatttccaccccattgaagcagctaaggctccgacaagctactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttggagacggagtcttgttctgttgccaggctggagtgcggtggtgcaatctcagctcactgcaatctccacctccgtgggttcaagaggttctcctgcctcagcctcctgagtagccggggagctacaagcttgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacgcctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgc

SEQ ID NO: 348867 - DNA, 2774 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttggagacggagtcttgttctgttgccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgc

SEQ ID NO: 348868 - DNA, 2450 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtctcaagtattcccatgtgttttaaaagcctgaagtcagtgagatgaaattcaacatcaagaatttgaagtaacttgtaaggaaaaataatataaagataccattggggcagtggctcacgcctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgc

SEQ ID NO: 348869 - DNA, 2357 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgactggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgc

SEQ ID NO: 348870 - DNA, 2142 bp, Homo sapiens
  misc_feature (19)..(19): n is a, c, g, or t
  misc_feature (47)..(47): n is a, c, g, or t
  misc_feature (59)..(59): n is a, c, g, or t
  misc_feature (107)..(108): n is a, c, g, or t
  misc_feature (112)..(112): n is a, c, g, or t
  misc_feature (118)..(118): n is a, c, g, or t
aaaaaatttcctccctttnttgaaagggcccaaaacccagtgtgaanaagaattgagtnctaaggctaaaagatggggaagccccccaaccttaccttgaaagcttnnagancatttnacaccagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttggagacggagtcttgttctgttgccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagagtttttggaagacccgtgttttgtgctttttgggtttcagtatagggttttttcctacagggctagagggaaagtaccccagcatttccaaccagtggggtgcaaaattatttgggtctacagctttacctattcctttcaagaacatttttgaaaaaacacatctgttaagttgaaccatgtgtaactgctgaatgctgatgtttggccgttttctacttaaaaaaataggccagcagtttgtaaattcaagctaatatatgaactttttgaaaaagttgttcttggacactaaaaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgc

SEQ ID NO: 348871 - DNA, 436 bp, Homo sapiens
aaaaaaaaaagagttatttcattccctctaggctgttcaggactgaagtgggagctgaagttgtgatctaattggcattttgaatctggaggccccttttgtggactcctttgtaagactttgggtgactggtattttatgctaaaaataggaatagtatgttttgaatggccatctgtcagtttacgttttttaaagtaaggggaatattgttagggaagtagacatccactgtctccttgccggggagaagtagtacagagtttggcaagtgaggagcatggtttgcatccatgcactgggtcagatctcagacctcagttctgtgagacagagttcctagggaagcattggcttatactgtgttataataagtgaaaaatctgttacttttaggtcttgctggctttttccctctgcatcctatgatgatcac

SEQ ID NO: 348872 - DNA, 3820 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttggagacggagtcttgttctgttgccaggctggagtgcggtggtgcaatctcagctcactgcaatctccacctccgtgggttcaagaggttctcctgcctcagcctcctgagtagccggggagctacaagcttgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacgcctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgtaaggtattatgaaggcaggtaggattatctccgttttacagatagggaagctgaggcctagaggtggaaacttgcccagtgatgtaagattcatctcccggttatgccctcctggaaagcccttcccaacatattatgttgtccatagagggaaaaatgagcaaagacagatggcttaactctggtgtgtgactaagatataggaaatttatagaggaggttctatcaatgtgccgacttactttgtgttttatgttctgagaacgattaccagccatctcaaattctgtggttgtcaaagctcccctggggttgttgctggttggcccccacttgctttgagactttgatgccagggcaggttgagaggaactgacttcagctgagtttgatcttggatctgggaaagagaaatgctttgaaaatcacggcaactctgggaagtttaaaagatattaatgtatcctggagagtttgaggctttgcagaaacttattggcagagcagaatgattctgaaaaatgctacatcagtgaggggatatttgataaggtattttctgccaactcgggtattcacttagcattgtttatcctttaagatatgtatacacatacttcctctgtgagtttaccctactaacaaagttttatccccagcctcaaccttgctttgggtctccaggcccaagtttctcaccatctcttggatgattgctccagcccactctgctgccacctgggatccaacatgttcaaacccagctgtgaacttcacagagtattaaaagaaagagcctttgcttcagcagtttatgttattaagacggaggcttgggtcatgttatctctctccaccaatgtgtaaggtgaaagtcctattaggtaagacggacgccagatttccagagcaaggggaggagagacccgagcaacatcacttccctgaagacctagctcctgcgcgcggccggggactgtgactccacatgccggcgttacttacccgggcccgcgcctgactcgccacacctcattttgcggccgc

SEQ ID NO: 348873 - DNA, 2689 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttggagacggagtcttgttctgttgccaggctggagtgcggtggtgcaatctcagctcactgcaatctccacctccgtgggttcaagaggttctcctgcctcagcctcctgagtagccggggagctacaagcttgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacgcctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgattaaaaaaaaaaaaaaaaaaaaaaaaaaaaaaaaaaaaaaaaaaaaaaaaaaaaaaaaaaaaaaaaaaaaaa

SEQ ID NO: 348874 - DNA, 2305 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctcttttttttttttttttggagacggagtcttgttctgttgccaggctggagtgcggtggtgcaatctcagctcactgcaatctccacctccgtgggttcaagaggttctcctgcctcagcctcctgagtagccggggagctacaagcttgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaaaaaaaaaaaaaaaaaaaaaaaaaaaaaaaaaaaaaaaaaaaaaaaaaaaaaaaaaaaaaaaaaaaaaaaa

SEQ ID NO: 348875 - DNA, 746 bp, Homo sapiens
agcgggcggcaagcggaggaggcgtggcgagcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcactactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgaaaaaaaaaaaaaaaaaaaaaaa

SEQ ID NO: 348876 - DNA, 744 bp, Homo sapiens
atgaggtagtgtagttgggggtgctcagggaggaggagggtcaggaaagtggggtttgtgttgctctgtgttgagtcagccgaccctgattctggtcctagctcttgttggtaaaaactcactcactttcctcctttcagctccagtttcattatctatgaaatgaggggatggaaccagaatctctttggaggttccagctgtatcctggggcctccctgaatgttcatggagatgttccttagccagtaattcaagatgaggaaaactaggcccaggtttccacaagagaaggggagggatcttgatgacctgtctcagagcggctgaagtggtactgttggaattagggtgggtgggtgggaggaggtagtttttaaagacctcccagaagtggaagcagagggctggaggtttcgtgaaggtgttgatgaggatccaccgggtggtaggggacatggctacgcgcttcccccgggaggcttgttggagatgggtttatgtgggagctgctgggggtgcctgctgtcctgcaaggggctgacccaagggaccctgctctaggaaagatgctccgtcctgtctggccctaaaccctggagagagaatgcagctgtggtttgagggagggtctgtgccccttgctgtcaggaagttttcctttatatttagccttctcttttcatgtattttttgaggccctcgactaaaaaattaaatttaattttaaaaaataacaatgaa

SEQ ID NO: 348877 - DNA, 470 bp, Homo sapiens
tataaatgagctttgtgaagtcgactgttcagtgccctgaatatcagctgcttgaaaacatctgaaaacaaagacattcatttacatctctgtccatgttaccctcctgaacatgtgtgcctgttacatatatctttggaatattgtccaggaaatcagacagctctcaccacttgatattggatccctctcacatacgtgaagtgtcctcagcaggaaaagctttaaccatggatcgattttcacaccacgtttcaatggagaacatgaactcaggccacagaactgtaacacttagaagactctgtggaatacgaacacttctctgatttatcctcatgaaattgttttcctgatgaaaggagtgttcttcagaagaatacagaatggatatctctttgttggagaacaaccgtatttttgttttaaaatgatattaaaataaatacatttacttcaagtaaggatta

SEQ ID NO: 348878 - DNA, 492 bp, Homo sapiens
gccccctgggccccgccgcgccccgccccgccccgccttccggcccggggtttgggaagaagaaaaagaaaccaaatgaccccagacttcagccgacagtcacatgataagaaaaataaattgcaggacagaactaggctaagaaaagcacaatcaatgatgtccctaagtgccagctctcccctaaaagttccagctcatctcgcctggcctccccctgagtcagtgggactcccagacactgccaccacagctgaaattctcatgcagcatcctcacaggcaccctgggccccaagcatgactcatccaggttccagagccaaagtggactgaacatggaaagacttttattatagaaatgacaagatgctttgcacagtggagagctgaatttacttggctcccattagaaactctttcagcttaagtacttattgtggtagtgagtcctacggtatttcagtaaaaaggaattcatggcaaaaaagtg

SEQ ID NO: 348879 - DNA, 773 bp, Homo sapiens
ctaaaaaatatctattttaaaaaatatttaaaattaaaatatgggaatgatgtcaatactctcatctaaaaatcccaagtctctagccccagctgtgacactttttagcggtgtgaacttggactgtcactcaaattcctcagtttcatttatttgcaaaatgaaacttattaatactatcctctctaccacatgtgatcttgaggttcagatgaaataaagttagtgagagcactttggacgctaaagaccgtattatctgtagctcagggtgaagattgcatgggggcagaggggagtgaagttgggaaatctcaataaatcccatccagccctataattttgtaaaatcgttttatgtcattaaaaataagtttaactagatagctcccttggtatttcaataaccctcgctttcatgattcctttttcctttctagatgtccctaagtgccagctctcccctaaaagttccagctcatctcgcctggcctccccctgagtcagtgggactcccagacactgccaccacagctgaaattctcatgcagcatcctcacaggcaccctgggccccaagcatgactcatccaggttccagagccaaagtggactgaacatggaaagacttttattatagaaatgacaagatgctttgcacagtggagagctgaatttacttggctcccattagaaactctttcagcttaagtacttattgtggtagtgagtcctacggtatttcagtaaaaaggaattcatggcaaaaaagtg

SEQ ID NO: 348880 - DNA, 1287 bp, Homo sapiens
gtgagggactggagggagtcggagaaaaagctgacctaatgaaactgtggcaacgtcagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccgggtatttgaagaaagaagagccctgcttggcaaatggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggaagaagaaaaagaaaccaaatgaccccagacttcagccgacagtcacatgataagaaaaataaattgcaggacagaactaggctaagaaaagcacaatcaatgatgtccctaagtgccagctctcccctaaaagttccagctcatctcgcctggcctccccctgagtcagtgggactcccagacactgccaccacagctgaaattctcatgcagcatcctcacaggcaccctgggccccaagcatgactcatccaggttccagagccaaagtggactgaacatggaaagacttttattatagaaatgacaagatgctttgcacagtggagagctgaatttacttggctcccattagaaactctttcagcttaagtacttattgtggtagtgagtcctacggtatttcagtaaaaaggaattcatggcaaaaaagtg

SEQ ID NO: 348881 - DNA, 1138 bp, Homo sapiens
gtgagggactggagggagtcggagaaaaagctgacctaatgaaactgtggcaacgtcagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccgggtatttgaagaaagaagagccctgcttggcaaatggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggaagaagaaaaagaaaccaaatgaccccagacttcagccgacagtcacatgataagaaaaataaattgcaggacagaactaggctaagaaaagcacaatcaatggtaagtattgtttatgaaagattcatcaccataacattaatgaaaatctccagatctctaatcctatttgcaaaattgaattcatttatttaatcagaatcatggagtggtgatttaaattcgggtttctgacactgactggcagagaagccatgaccttgaagatacactttatttaatctct

SEQ ID NO: 348882 - DNA, 1251 bp, Homo sapiens
gtgagggactggagggagtcggagaaaaagctgacctaatgaaactgtggcaacgtcagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaagacacccccaaaggatggatttgtaatcgctgacgttcaactagttacaagcaattctccagaggaaaaacagtcccctttatcagcttttcggtcctcttcctctttaagaaagaagaataactcaggggagaaagcacttccaccctggcgatcttctgataagcacccaacagatatcattcgttttaattacctagacaaccgtgaccccatggagactgtccagcaaggaagaagaaaaagaaaccaaatgaccccagacttcagccgacagtcacatgataagaaaaataaattgcaggacagaactaggctaagaaaagcacaatcaatgatgtccctaagtgccagctctcccctaaaagttccagctcatctcgcctggcctccccctgagtcagtgggactcccagacactgccaccacagctgaaattctcatgcagcatcctcacaggcaccctgggccccaagcatgactcatccaggttccagagccaaagtggactgaacatggaaagacttttattatagaaatgacaagatgctttgcacagtggagagctgaatttacttggctcccattagaaactctttcagcttaagtacttattgtggtagtgagtcctacggtatttcagtaaaaaggaattcatggcaaaaaagtg

SEQ ID NO: 348883 - DNA, 726 bp, Homo sapiens
gtgagggactggagggagtcggagaaaaagctgacctaatgaaactgtggcaacgtcagcgcttgaggcttgaagagggagacaagctaaaagaggatatccagttgtttcatgatggcatttgcacctccaaaaaacacagatggtcccaaaatgcagacaaagatgagcacctggacacccctaaaccatcagctattgaatgaccgggtatttgaagaaagaagagccctgcttggcaaatggtttgacaaatggacagactctcaaagaagaagaatcctcacaggcctgttggagcgctgctcgctgtcccagcaaaagttctgctgtcgaaagcttcaagagaaaattccagcagaagccctggactttacaaccaagcttccaagggtgttatctttatacatcttttctttcctggaccctcggagcctttgtcgttgtgcacaggtgtgctggcattggaagaaccttgctgagctggaccagctctggatgctgaaatgtttacggtttaactggtacatcaatttctctccaactccctttgagcaggggatctggaagaagcactatattcaaatggtgaaagaacttcatattaccaagcctaaggtgaattttagacagaaagccacaagcttgcaaacattggctctttgcaaattctagaactaagaataaaggatcagactggaagttggggaagggaggtagttcaaa

SEQ ID NO: 348884 - DNA, 571 bp, Homo sapiens
ccacaatgaaaaacataaaaatctttaaaatatcaagcaagtgcatcaaggcctttgcctgggcccctcatcccccaggtgtccgcatggctcatgccctcactgtattcaggtgctttgcccaaatgtcacctcctcagaaatgcttgccccccaccccctatctgaaatggcacttccatgcacacttctccatcactttatctgcctcatttttctttgcagcatttagcatcctgagtgctgaacccgctggcctttcaaagtgtctggtgcttagctggagctgtgataggaacagcagggtctatgcatttggggttcaaaggtggccgtattcttggaggtcccagtagtaggaagtagtaggtcctcacctgggggtgcagggctgttccctggatgtgcagactggatcatatggagggtaaatgagatacagggagacagtagttctagaacaagaaggcgaggtctgcactatgggtagcaatgagaatagaaaaggaagtctgagtgccttttttccttcctacaatcctgagaaagattttggacctttaaaatgaaa

SEQ ID NO: 348885 - DNA, 394 bp, Homo sapiens
atcacaattatattttacttgacattactattttcttaaggaggctaacagaaaaatcaatgggtgggcataaagagaaagaaatcatatgaggctaccacacatattctgttactgaatttctttcacctaaatatacaatggaatgctctgaattgtatgttttcttttcccatcatattaaactaaagcaaagttcttgggctgaaagtagaaaaactgcactttagtgttctaatgatccacacctttcacatattcacttcgcttacaattctagatgctaactcaataagaaagaaagaaacaaattcagagtatttcagtcaccaacaacaacagcagtaacaataacaataatattaatatcagttaatatttatttaactcttag

SEQ ID NO: 348886 - DNA, 3122 bp, Homo sapiens
aggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaa

SEQ ID NO: 348887 - DNA, 3702 bp, Homo sapiens
aggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaaaaaaaaaaaaaaaaaaaaaaaaaaaaaaaaaaaaaaaaaaaaaaaaaaaaaaaaaaaaaaaaaaaaaactaaagggggggcccagatcccatattccccctatagagacccgaattccaattcattgcccaatgcttaccaaccgcggggactggaaaaaccctggcgcctccaaatttaatcttcttgaaggaaatacccttttagtcacctaggcaaatatccaaaaggccattcacctgttcccccttcctagcatttcgcaaaacggaatggccaatggcaaattgcaaccgttatttcttcgttaaaatccacggtaaattttaaatcaataatctcatttctaaaccaattggcctaaattggattagaaacaccagtccctcttttagaacgtgcctcctcggtaacagggcaaatccctttattgggccatgccccttacgtgaccattccctattaagttttagggccccacggccccaaaccctaaacgtaactctatgggacccccatttagactttactggacacaccaggaacctctcgcaatgaattgactatcgacaggcccccg

SEQ ID NO: 348888 - DNA, 3165 bp, Homo sapiens
aggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacggggctcccttcccttggttggccgggggttggtcacggcgagggagggaatagggccccgaatggccggcaattcccaacaggcttctggctctggaagcgcaacacagggtaagcacggtaaaaaaaaaaaaggggggcaaacccggagcaagacactttaaggcgcaggtgaaaagggggccggggaaaggcgagaatggggacacagaatatttgt

SEQ ID NO: 348889 - DNA, 2584 bp, Homo sapiens
aggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccacgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaa

SEQ ID NO: 348890 - DNA, 2242 bp, Homo sapiens
aggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaa

SEQ ID NO: 348891 - DNA, 1818 bp, Homo sapiens
cccagggaatgccctgcttcaccagccaaggttccagtctgggccaccaggagtaggtagattaacctcgtccagtggacactcagcttgttagcagagctgcatggaaacaggcgagatatattggacatgtgtcaggggtgctttggaagggtagaggaactgaaatacggacacagagccagtagggagaggctaaggaggcaaagaagcagcaccctccgaaggatccaccaacccattctgtcaccagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaa

SEQ ID NO: 348892 - DNA, 1042 bp, Homo sapiens
atccacagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaa

SEQ ID NO: 348893 - DNA, 424 bp, Homo sapiens
gaagtgccccttctcacacagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtgagtagtgccctctccttccccaggccccctcctggtcagcaccctctgggcatactcctccttcagcttccctcagcacctctgtgtttgattctagtcttagagtagttcctatcggctgggtgtgttggcccacacccgtaatcccagtacttcgggaggccaagatgggagaattgcttgagcccaggaggttgagaccagcc

SEQ ID NO: 348894 - DNA, 3191 bp, Homo sapiens
aggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaaggtagccttggtttctatggcaacgaagacgaagactccttctgctcccctcacttctcctctccgacatcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaa

SEQ ID NO: 348895 - DNA, 2875 bp, Homo sapiens
aggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaa

SEQ ID NO: 348896 - DNA, 2541 bp, Homo sapiens
ggctagtagaggcctgggtgttaattcgccgagggttggacacctgcgtcgaatcctccctgtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctgacgtgtactcatatgatgaggatgacatggtcctggaccccagcctggctgagcacctgtcccacttcggcatcgacatgctgaagatgcagaagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtatgtggataagctggagaagatcttccagaatgccccgacggaccctacccaggatttcagcacccaggtggccaagctgggccatggccttctctccggggagtattccaagccagtaccggagtcgggcgatggggagcgggtgccagaacagaaggaagttcaagatggcattgcccctcggatgttcaaggccctcatcggcaagggccaccctgaattctccaccaaccggcagcaggatgcccaggagttcttccttcaccttatcaacatggtggagaggaattgccggagctctgaaaatcctaatgaagtgttccgcttcttggtggaggaaaagatcaagtgcctggccacagagaaggtgaagtacacccagcgagttgactacatcatgcagctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaa

SEQ ID NO: 348897 - DNA, 2396 bp, Homo sapiens
aggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggagtctgaggggggcctctacatctgtatgaacacgtttctgggctttgggaaacagtatgtggagagacatttcaataagaccggccagcgagtctacttgcacctccggcggacccggcgcccgaaagaggaggaccctgctacaggcactggagacccaccccggaagaagcccacgcggctggctattggtgttgaaggcggatttgaccttagcgaggagaagtttgaattagacgaggatgtgaagattgtcattttgccagattacctggagattgcccgggatggactggggggactgcctgacattgtcagagatcgggtatgactgccccctatgctacccaagattctagagcaagatgggccagggtagtggtgtcttaggcaagcactgacaaagctgaaggccaaggggaagaggggcatgtggggcagggggttgggtattgcctctgaccctctgcttcccccaggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctgctgcctgtgcccatggatgcagcccttaacaaagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagaccacacgatttgcctcattccctgactacctggtcatccagatcaagaagttcaccttcggcttagactgggtgcccaagaaactggatgtgtccatcgagatgccagaggagctcgacatctcccagttgaggggcacagggctgcagcccggagaggaggagctgccagacattgccccacccctggtcactccggatgagcccaaagcgcccatgctggatgaatcagtcatcatccagctggtggagatgggattccctatggacgcctgccgcaaagctgtctactacacgggcaacagcggggctgaggccgccatgaactgggtcatgtcacacatggatgatccagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacgaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaaagtatcagctctttgccttcattagtcacatgggcacctctaccatgtgtggtcactacgtctgccacatcaagaaagaaggcagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatccacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaa

SEQ ID NO: 348898 - DNA, 569 bp, Homo sapiens
ccagaaacagggcccattctgtgagaatgggcagggacccacattacaattgtgtggtcattttggttttgggataaggtgccaatccatgggagaaaaatgcatggaatgggtgattggaagagggctgggtcctgggggagggaggaggagcaaacagtggcccaatcagtcggtccgtgtacccacaattcccattacagcgcccatgctggatgaatcagtcatcatccagctggtggagatgggattccctatggacgcctgccgcaaagctgtctactacacgggcaacagcggggctgaggccgccatgaactgggtcatgtcacacatggatgatccaggtaggctggggtggggagcagggtggggcagggcctccatcctcccccaaacacatcaaccccttcacatccacagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacg

SEQ ID NO: 348899 - DNA, 3625 bp, Homo sapiens
  misc_feature (15)..(16): n is a, c, g, or t
ggggatatctctagnnagcggccgccgccgccgcgggagcgctcccctgcccaccccgcccccgcggccgagcccgggagtcgagtgggagtcggccggccggcgcgggcagcgccgggaccccgcgggggacactgcagccggagcccgggaggggccgcgccgccaccgtctgaactaggatgtcccgacatgaaggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttgatttatactatggtggggaagctttctctgtagagcagccacagtcttttacttgtccctattgtggaaaaatgggctatacggagacatctcttcaagaacatgttacttctgaacatgcagaaacatcaacagaagtgatttgtccaatatgtgcagcgttacctggaggcgatcctaatcatgtcacggatgactttgcagctcatcttacacttgaacacagagcccctagagatttagatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctgagcttttatctcagttatcaggagtgagacgttctgcaggaggacagcttaattcctctggcccttccgcttctcagttacaacaactgcagatgcagctgcagctagaacggcagcatgcccaggcagcacggcaacaactggagaccgcacgcaacgcaacccggcgtactaacacaagcagtgtcaccactacaatcacacaatccacagcaacaaccaacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttaaaaaaaagaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaaaatgtaaaagccttcattttttaacatggttttagggaacaactgtaagtccattcagagcagtttaatttagatgatcacttttaacactgcagaagacctaaggagtcataagattccatctcatgtagaatactgtatattaattattttttaccagatattttacaaatacctcacctcatcctgtatgtaatcaataatgtattattttagggtagaacgacacagaatatcaatataaaaatatattcaagcccttgaaattc

SEQ ID NO: 348900 - DNA, 3156 bp, Homo sapiens
  misc_feature (15)..(16): n is a, c, g, or t
ggggatatctctagnnagcggccgccgccgccgcgggagcgctcccctgcccaccccgcccccgcggccgagcccgggagtcgagtgggagtcggccggccggcgcgggcagcgccgggaccccgcgggggacactgcagccggagcccgggaggggccgcgccgccaccgtctgaactaggatgtcccgacatgaaggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttgatttatactatggtggggaagctttctctgtagagcagccacagtcttttacttgtccctattgtggaaaaatgggctatacggagacatctcttcaagaacatgttacttctgaacatgcagaaacatcaacagaagtgatttgtccaatatgtgcagcgttacctggaggcgatcctaatcatgtcacggatgactttgcagctcatcttacacttgaacacagagcccctagagatttagatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctgagcttttatctcagttatcaggagtgagacgttctgcaggaggacagcttaattcctctggcccttccgcttctcagttacaacaactgcagatgcagctgcagctagaacggcagcatgcccaggcagcacggcaacaactggagaccgcacgcaacgcaacccggcgtactaacacaagcagtgtcaccactacaatcacacaatccacagcaacaaccaacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaa

SEQ ID NO: 348901 - DNA, 3469 bp, Homo sapiens
tctttgtgcatcttgttaatatgcactgcattgggtggtcagttgtatgccttgtccctattgtggaaaaatgggctatacggagacatctcttcaagaacatgttacttctgaacatgcagaaacatcaacagaagtggtcaagctctggggtccctagaagttcttcctatcctgatctttccagtggctaaaggccatggacccagaataatacacaaagaaagtcttaccttgaaagcttgttggattttttacttgacatctgagtcagcatgcatccaccttcaagaaatgataaagtacacctaagagtctctcccccacctctttaccattgataataatagatttgtccaatatgtgcagcgttacctggaggcgatcctaatcatgtcacggatgactttgcagctcatcttacacttgaacacagagcccctagagatttagatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctgagcttttatctcagttatcaggagtgagacgttctgcaggaggacagcttaattcctctggcccttccgcttctcagttacaacaactgcagatgcagctgcagctagaacggcagcatgcccaggcagcacggcaacaactggagaccgcacgcaacgcaacccggcgtactaacacaagcagtgtcaccactacaatcacacaatccacagcaacaaccaacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttaaaaaaaagaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaaaatgtaaaagccttcattttttaacatggttttagggaacaactgtaagtccattcagagcagtttaatttagatgatcacttttaacactgcagaagacctaaggagtcataagattccatctcatgtagaatactgtatattaattattttttaccagatattttacaaatacctcacctcatcctgtatgtaatcaataatgtattattttagggtagaacgacacagaatatcaatataaaaatatattcaagcccttgaaattc

SEQ ID NO: 348902 - DNA, 2502 bp, Homo sapiens
  misc_feature (67)..(67): n is a, c, g, or t
gacactgcttgtgttagtacgccgggtcgcgttgcgtgcggtctccagttgttgccgtgctgcctgngcatgctgccgttctagctgcagctgcatctgcagttgttgtaactgagaagcggaagggccagaggaattaagctgtcctcctgcagaacgtctcactcctgataactgagataaaagctcagctataggatccatggcttccctattgcttggagaaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttaaaaaaaagaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaaaatgtaaaagccttcattttttaacatggttttagggaacaactgtaagtccattcagagcagtttaatttagatgatcacttttaacactgcagaagacctaaggagtcataagattccatctcatgtagaatactgtatattaattattttttaccagatattttacaaatacctcacctcatcctgtatgtaatcaataatgtattattttagggtagaacgacacagaatatcaatataaaaatatattcaagcccttgaaattc

SEQ ID NO: 348903 - DNA, 3826 bp, Homo sapiens
agcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgaggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttgatttatactatggtggggaagctttctctgtagagcagccacagtcttttacttgtccctattgtggaaaaatgggctatacggagacatctcttcaagaacatgttacttctgaacatgcagaaacatcaacagaagtggtcaagctctggggtccctagaagttcttcctatcctgatctttccagtggctaaaggccatggacccagaataatacacaaagaaagtcttaccttgaaagcttgttggattttttacttgacatctgagtcagcatgcatccaccttcaagaaatgataaagtacacctaagagtctctcccccacctctttaccattgataataatagatttgtccaatatgtgcagcgttacctggaggcgatcctaatcatgtcacggatgactttgcagctcatcttacacttgaacacagagcccctagagatttagatgaatcgagtggtgttcgacatgtacgtagaatgtttcaccctggccggggattaggaggtcctcgtgctcgtagatcaaacatgcactttactagcagttctactggtggactttcttcttctcagagttcatattctccaagcaatagggaagccatggatcctatagctgagcttttatctcagttatcaggagtgagacgttctgcaggaggacagcttaattcctctggcccttccgcttctcagttacaacaactgcagatgcagctgcagctagaacggcagcatgcccaggcagcacggcaacaactggagaccgcacgcaacgcaacccggcgtactaacacaagcagtgtcaccactacaatcacacaatccacagcaacaaccaacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttaaaaaaaagaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaaaatgtaaaagccttcattttttaacatggttttagggaacaactgtaagtccattcagagcagtttaatttagatgatcacttttaacactgcagaagacctaaggagtcataagattccatctcatgtagaatactgtatattaattattttttaccagatattttacaaatacctcacctcatcctgtatgtaatcaataatgtattattttagggtagaacgacacagaatatcaatataaaaatatattcaagcccttgaaattc

SEQ ID NO: 348904 - DNA, 3002 bp, Homo sapiens
gaccatgatctaccgaatttcgagcttccggtagccccggaaattccgtcgtgggttcgtagatcaaacatgcactttactagcagttctactggtggactttcttcttctcagagttcatattctccaagcaatagggaagccatggatcctatagctgagcttttatctcagttatcaggagtgagacgttctgcaggaggacagcttaattcctctggcccttccgcttctcagttacaacaactgcagatgcagctgcagctagaacggcagcatgcccaggcagcacggcaacaactggagaccgcacgcaacgcaacccggcgtactaacacaagcagtgtcaccactacaatcacacaatccacagcaacaaccaacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttaaaaaaaagaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaaaatgtaaaagccttcattttttaacatggttttagggaacaactgtaagtccattcagagcagtttaatttagatgatcacttttaacactgcagaagacctaaggagtcataagattccatctcatgtagaatactgtatattaattattttttaccagatattttacaaatacctcacctcatcctgtatgtaatcaataatgtattattttagggtagaacgacacagaatatcaatataaaaatatattcaagcccttgaaattc

SEQ ID NO: 348905 - DNA, 3334 bp, Homo sapiens
  misc_feature (15)..(16): n is a, c, g, or t
ggggatatctctagnnagcggccgccgccgccgcgggagcgctcccctgcccaccccgcccccgcggccgagcccgggagtcgagtgggagtcggccggccggcgcgggcagcgccgggaccccgcgggggacactgcagccggagcccgggaggggccgcgccgccaccgtctgaactaggatgtcccgacatgaaggtgtcagctgtgatgcatgtttaaaaggaaattttcgaggtcgcagatataagtgtttaatttgctacgattacgatctttgtgcatcttgttatgaaagtggtgcaacaacaacaaggcatacaactgaccacccaatgcagtgcatattaacaagggtagattttgatttatactatggtggggaagctttctctgtagagcagccacagtcttttacttgtccctattgtggaaaaatgggctatagttcatattctccaagcaatagggaagccatggatcctatagctgagcttttatctcagttatcaggagtgagacgttctgcaggaggacagcttaattcctctggcccttccgcttctcagttacaacaactgcagatgcagctgcagctagaacggcagcatgcccaggcagcacggcaacaactggagaccgcacgcaacgcaacccggcgtactaacacaagcagtgtcaccactacaatcacacaatccacagcaacaaccaacatagctaatacagaaagcagtcagcagactctacagaattcccagtttcttttaacaaggttgaatgatcctaaaatgtctgaaacggagcgccagtccatggaaagcgagcgtgcagaccgcagcctgtttgtccaagagctccttctgtccactttagtgcgtgaagagagctcatcctcagatgaggatgatcggggggagatggcagattttggtgctatgggctgtgtagatattatgcctttagatgttgctttagaaaacctaaatttaaaagagagtaataaaggaaatgagcctccaccacctcctctttgatgacatcccaattcgcagacaatgtcctctgtgctgtatttgccaatgaaagtggacaacaactatcttgggtttgtttggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggtttaccttaactactgcatgaggttttttgcagcgtgcatgagttttagtgaccttgttatttaagaagttaaatacaaggagtaaaacttaaaaaaaaaatacaaagcccaaagctttcccaaacattattcaatggttacacgacgaagtagcttttgaataatgtctgcctgaatcacctttctttgtgtgcctcctacgcacaaagccagctctgcagtggaatctggggattatagccgggtgtggcactccgccctgtgtgactgtcctgtcgccctgttagtcatcttgcctgtgtggagctcagcctgtctctttaactcatctgtagaagacacaccagtaaagctactgttggaatctgctgcaggggcctttgtgtgccctaaaaacaaatcctgttcatgtttgtttaaagtttttactttttgtggttgtttaaaattttttcaattgttaaatatgttttattcaggtgtagatgaatttcatttattgactgttcaacagagttaacctgaattatgttgtctttgtttttaaaaatctcacattctcaatcatattttgcattatttatgtatttgctttgtagtttgctgagacagatcagtatcaggggagctttgaggatttgccttcccagatttgtcagtatattacaaccaaattcttaatgctaattttagcaccttttatttattgggttttttctggcataaaaagtaaagccttttaattgaatcatgccacctatatgcctatattattaatcctatgtgtaaaaaaaatgtacagctttttttgggtttgttttggggtttggaagggccgggttattttttatttcctgtttcagtttttgtgcatagactttcacaatagctccaaggcagggacagcgggtttgggggttgggagggcagtttttggaatgtaaatttaggacttttaaaaaggtgcgcacagcttctgataaatttataactagacttaacctaatcatgtctcgttccagttctcttttctctgagcccttttcaaagtctcctctctttctcctgtcatccttttcctttcctgtccgtgtatctccgtttcttcaacatgacaagcatacagacttgaacacccctccggtgttcttccgagaactgtgaagtccatgttcatccaaatgtaaccaaaaaagaagtcaccctacatgtctgaaaaactgttgcttctcctctgaaacttcaaactccaacgatttccaaatacaatagctttgttttctttagttctgtaatggataatgtttaaaggaaaactttacaccaggcttctggttacactagaagtcaagcccattagggattttcattttttttcatttggttgttgagaagtttcaaaaatcagttttcaagctgtggtctttcaaacacatctgcacataagtcacacatttcaataaagcattttcaagactgttaaaaaaaagaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaaattctgggaaaatgtaaaagccttcattttttaacatggttttagggaacaactgtaagtccattcagagcagtttaatttagatgatcacttttaacactgcagaagacctaaggagtcataagattccatctcatgtagaatactgtatattaattattttttaccagatattttacaaatacctcacctcatcctgtatgtaatcaataatgtattattttagggtagaacgacacagaatatcaatataaaaatatattcaagcccttgaaattc

SEQ ID NO: 348906 - DNA, 685 bp, Homo sapiens
tggatctacttgaaggggccttttttgcctgtggggcaggaggtgcactgatttgaaaaggttcttccagttggccttgggaccagaactgcttccgccctgggatgtgccatcgcggaattctttgtggaggacccggtgtcttcctgcctctccgaatcactgcactcagggcttatggggagggagcagagacggcactcgcgccactttccttactaggaggggggtttctaagtctggtccttcaaccaagggactgacaacttaggggagctttccctgcaactcaggagcaggaagggagtggtgggaactatgtatccaaacacgtttcagcgtcagggtcactttgtttttcccattcatctgtccaaaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagatcccagatcccgacgtctctaccgtcgcccaagccccagcgtccatccccgcacga

SEQ ID NO: 348907 - DNA, 6935 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348908 - DNA, 6853 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348909 - DNA, 5579 bp, Homo sapiens
atccttctgaccctccactgtggactcaatagcagggagatgaagaggacagtgactgagagaccaaggcagccctggttaaagtagaatgccccttcgagtgtctggggtagttggtgagtgggaggtgggaagggtaggccagagcccacctgcctcctccctcctcctaggtctgacgctgcaccctccctacgttccctgaggtgcgtgccaggcgtgtgtgagcaggcgtgtgcttccggcacacagggaacctagcagcctctgtacacacgccctcgtccccactgagtcccctgggtagagcagacctgtagactgtttccctcagggacattgagaagtagtgaggcttgatcctcttctacgtcccttttgccgctctgtttccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348910 - DNA, 6024 bp, Homo sapiens
tgtctgctatggtgtcttatggcatctcaagactcatcatattcaaaactcgattttcctcccggtccttctgcttgtccagtccacatcctccttggctccctgctccccctcacctcacccccttacccttcagcaggcctgtcagctctggctttaaaaggattcagaatccagctgtgtctcatcccctccacaccactgcatgctgtccagctcctgtagggactcctacctggcctccctgcaagtcagatcataccccaagtcagcactctataaatggcagcatgttcccatcattttcatcctgcaccattttggtgctccaaggaggagcatggtgttttgcggctctggccaccacaagtctcagtgatgtaattccaatagatccttctgaccctccactgtggactcaatagcagggagatgaagaggacagtgactgagagaccaaaagtggcccagccccctaccccatcctgttcccctgtccttacagtctctgggcccacatccccacctcgcatatcttgttctagttagttaggccctgcagctaccctgttctcctgtcagcatgcttcaaaggacccccacagtctggaatccagcccagtcttgtttttaccaccacttgatgcaaaacagtaagagtcttgaacgtgtgtgctgtacaaaggaatgcagagatatacgtccgatgcagctttcatcttttgggacttggcttcgccattacttctgactttcctcactcgtcctctccttgcccaccccgccccgtgtgcacccataaatctggtgtgcacccacagatcctatgccgctctgcatcccgagtgtcctgcagctgtgtccagtgtgtgacacactatcctggcagtgtgcaggcccatgttggacagggccctgccgcttccttggcaccttgtatgctttcagtaagcacttgctggacaaaggcagaaagggctgaagatagacgcagcccttagcagagatgtggatgagacacacttaacgctgttagttcccatgcctgcagccagcttagtcttgcccgttttctcaccacctactctattccagcaagaagacgtgcctctgccatcgaaggtgtgaaatcctgggcgatctctcctgtgctgcagtagaaattagagcatgtcctgctttatgcaggctttgctttagttcttctgaagtgtatgaatctgaagtgcatgtgcggtcgctctttggtgcgtttggggtttctccatagcatcattccccctcctgactgtcattgtcgcccagcagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348911 - DNA, 6710 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348912 - DNA, 4947 bp, Homo sapiens
cacagttctggctcagcgtcaggcttctaggccttttgtctggggcactgcatcgtgttggtccagaccctgagacggccagtgtcgctttctgcacagcaggacagccatgcccatctgtacagggcctcagcctccctctcttgcggtgcgtctccttgagctctgtcctggaggtgccagggtggtcagtgacagccaccccctcacccttctgcgttctgggctgtcttaggtctgtggttgttttccatccaagagatccacggaccgtcccgagtgagcgcctctggccgcaggcccttccttccttgtgcctcctccatgtgctaggctttgactccatttctgtggtgacacgttgtgtattctcaacccctgcctttggttttttcaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348913 - DNA, 4744 bp, Homo sapiens
tggtctgtgggaaaattgtcttccatgaaactgggccctggtgccaaaaaccactgctctataagatgcctccctgggaattcccatggccctcaccacctctgccctgggttgttcagtaagtgtgtggtccagctgtctccagggcctcaaatgacagcttgttcctgcttggtctctctagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348914 - DNA, 4522 bp, Homo sapiens
ttaggcgcctgtctgcgtctcacgggttcaggacaagcgctcaggcttggctcttaagctctgtgtctaagtgtagaacatggggaaggatccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348915 - DNA, 4099 bp, Homo sapiens
  misc_feature (7)..(8): n is a, c, g, or t
attagannaattataacaacaacttatcaaaggttcctgaaattaattttgcatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348916 - DNA, 6829 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348917 - DNA, 6477 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttggccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348918 - DNA, 6759 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttcgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348919 - DNA, 3525 bp, Homo sapiens
gtgtcgtagttggtgcggcttagcgtggtgtcggtgattgatgcagcgcggtggtggtgtgctcgctctggtgctctacctgcgttccgtcatatactagcaccgacggacattggttttcttgcggaccctgtctgaatacgctggccaaccggtgcgcccacatcgagtcggggccccgtcccggggtttacacacgcctcaggccctggctttttggccctccgccgccgggcctgtgtgcccagtcttccctggccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348920 - DNA, 5689 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348921 - DNA, 2642 bp, Homo sapiens
ccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcaggaatgaaagctctttctctgcctcactcggaagggcagggggcgtaagtgctcagcgcgatctctttgaggagagaggggaggagtacttgagtgcttttgacaagaaggcccaagcagactttgacagctgtatctcttctcaaagaataggccaggagcttttgtttccaccccaagaaaatgttcaggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348922 - DNA, 938 bp, Homo sapiens
ccccgggctgcaggaattcggcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348923 - DNA, 924 bp, Homo sapiens
  misc_feature (9)..(9): n is a, c, g, or t
  misc_feature (53)..(53): n is a, c, g, or t
  misc_feature (167)..(167): n is a, c, g, or t
ccgagaaanacaagaaaaagggggtgcaaccggctgaagaccttgattcacgntaccaggttccccatttcccaagaatggctggaaggaccacaactttggacttgactgatttcttgaatgtgaaataaagtcatcttttgttttcccccttaaggaacctaganccagatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348924 - DNA, 1803 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggtatctcatcccctgagcaaggccttggggtccttctccatttattatcaagaaaaacggattaacagccccgaatgtcacctcctggccttgtcttaagtagcatgtagaagtagcaacttgtttttaggcc

SEQ ID NO: 348925 - DNA, 704 bp, Homo sapiens
ccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcaggaatgaaagctctttctctgcctcactcggaagggcagggggcgtaagtgctcagcgcgatctctttgaggagagaggggaggagtacttgagtgcttttgacaagaaggcccaagcagactttgacagctgtatctcttctcaaagaataggccaggagcttttgtttccaccccaagaaaatgttcaggatgcaggtgctcctgggggtcacacccaaaacctcaggtgttccccattggagcctgactttgtcccagatgagaaaaagccagagtgtggcagttgggatgttagccaccagccagagaccgctgacacagcccatggtgttgagcgggagacaccccgggaggggacggcctttaacatctcctcctgggacaagaacggg

SEQ ID NO: 348926 - DNA, 504 bp, Homo sapiens
tctggggctgtagaggtgagcagagtaggtaggattcccaccgagtgttgctcacagcccgttgaatccccgtgacaccctgcagcttccgggctttaaagagaggaagcctggggcccagagacgttcggtggtgtgtccgaggtcacacacagctgtaggagcagagctggggtttaagctctttgcgtgttctctcagttgtgcccttgggcctctttggtttggggtaacaatgtgttagatcagaggcggcctgagaaaagtgcggaagtcctgtccaggtttctgtcgagcctgatgctagatctcaggcgcctgttgaattgggttgttcttgtctcctggtgagtggaaagactgttccttctcgtgaaatcttggttcaggtgccatcattgaaaattgcgggtccagccccggggaggagagtgaggtgggttctatggtgggcgaaggcttcatcgaagtcctgaccaagaagcagcgccgcctgctggagga

SEQ ID NO: 348927 - DNA, 529 bp, Homo sapiens
cacagttctggctcagcgtcaggcttctaggccttttgtctggggcactgcatcgtgttggtccagaccctgagacggccagtgtcgctttctgcacagcaggacagccatgcccatctgtacagggcctcagcctccctctcttgcggtgcgtctccttgagctctgtcctggaggtgccagggtggtcagtgacagccaccccctcacccttctgcgttctgggctgtcttaggtctgtggttgttttccatccaagagatccacggaccgtcccgagtgagcgcctctggccgcaggcccttccttccttgtgcctcctccatgtgctaggctttgactccatttctgtggtgacacgttgtgtattctcaacccctgcctttggttttttcaggcctagctctgctagccccagtgggaagccctctggatcagcagttaacatgggctctgtgcagggacactacgtgcaacaggtagaagatggctttccagacccttcagccctggacacttaggcccgtct

SEQ ID NO: 348928 - DNA, 6914 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggtatccttctgatgaagagaagaaaggcctaaactcccaggcatggatgcattagaaagaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348929 - DNA, 5132 bp, Homo sapiens
atctgctgggccgcggcggcctgttggtaactctgctgctgaggtatcgtttgaggaaccagccggggctgacttgcaaacacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348930 - DNA, 6978 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgctttactgtcatcaacttcatgggctgcctgtaagcgccctggctcacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348931 - DNA, 6710 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348932 - DNA, 6109 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348933 - DNA, 6796 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaacttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348934 - DNA, 5865 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgaccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348935 - DNA, 6111 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcgatggggtgctcagagcagcaggcaggttgggggagggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacatactacaggcccatcccaggccccgtgggctctgcttctggggctccataccctgccctgcaggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaagcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaagtgcgcctgggtgcagaagtgcgcctgggtgcagaagtgcgcctgggtgcagaagtgcgcctgggtg

SEQ ID NO: 348936 - DNA, 2558 bp, Homo sapiens
ccagaactcctccgatcacgccaatgaggagtgggagacggcctccgaaagcagcgacttcagcgagcggcgggagcggcgggaaggccctgggtccgagcccgactcccaggtggatggtggcctgtcgggggctagtttgggtgagaagaaggagctggccaagaggagcttctccagtcagagacccgtggttgacagacagagccgaaagctggagccgggagggtttggggagaagcccgttaggccaggtggtggtgacacctcccctcgctatgagagccaacagaatgggacgcctttgaaagtgaaaagatccccagacgaggccttgcctggaggtcttagtggctgcagcagtgggagtggccactccccctatgccctggagcgggcagcccatgccagtgctgaccttcccgaagcctccagtaaaaaggcagagaaggaggccaagttggctgctccgagggcaggtgaacagggagaggccatgaaacagtttgacctgaactatggaagtgccatcattgaaaattgcgggtccagccccggggaggagagtgaggtgggttctatggtgggcgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacagagaacaacgcctgggttacgagggtctgctgggcaatggcctctcgcaagaccaaggcatcccaggcatgtgctagccactcctgtcgtgctcctgctgatagactgggccaaccgctcagctttccagtgaaacgcccagacactcccccctcgcccgaccgccaccggaac

SEQ ID NO: 348937 - DNA, 669 bp, Homo sapiens
ccaggtggatgatgatgccttcctacatggacccacgtatcacgcccactcggaccccggtggacttctacccctccgccctgcatccctcaggactgatgaagcccatgatgccccaggagtccctcaatgggacaggctgtcgctctgaggatcagaactgtgtgcccccactccaagaaagaaaagtgacccccatcgactcaccccctgtgtggagcccagagggctacatggcactgcagagcaagggctacccgctcccgcacccgaagtcgagtgacaccttggctatggacatgcgtgtcaggaatgaaagctctttctctgcctcactcggaagggcagggggcgtaagtgctcagcgcgatctctttgaggagagaggggaggagtacttgagtgcttttgacaagaaggcccaagcagaacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagataaaaaaaactgaa

SEQ ID NO: 348938 - DNA, 643 bp, Homo sapiens
ccagcttccactctaagcacacgttaacgctagacactagtaatgcaatgaaggtaaccaaagcaaaaacaacccaagctgagcttacctcccaactcactgacttgatccccacactaacagtaaagtagaagaagcatccccaattgtaagcataaatacaattatgagaaaattacgagacatatacacaaaagaagaaaaaaacaacacactgtcaagggacaaagaaatcaacagaagcagactgagggatgacccagatgttagaactatcagacagggaatttaaaatgactatgactaatattaaaggcgccagtggaaaaagcagacaaatgtatgaacagatgagaaattctagcagagttggaaactccaaaagtcaaatggaaatgctaaaaacaaatacagtagcagatatgcagaatggtttcaacaggcccatcatgagatttgacatcatcaaggaaagaattagtggaagacaggtcaatagatattatctaatacaaataacccaaactgatgcacaaagagaaaaaagaataaaaaacacaaaacagagaacccaaaagctgttggacagactgagcacagtggctcacgcctgtaatcccaacactttaagggactgaggcag

SEQ ID NO: 348939 - DNA, 552 bp, Homo sapiens
attgactgatgttttcctccctattaatttcccgtaggaatggtaaaaatgcaattattcatctatgaaaatggtgtttaagaccttgaaaatgaagagaatttggaaagccacttgtgccataaaatttctgaacacagaaacgggccagtgattcagtcgatattgattgattggttgattgattttaatttcttctccagctttattgaggtataattgacaattaaaaattgcatatactcaaaatgtacatatgatgttttgatttcattgtgaaatctttactataatcaagccagctaatatatccatcacctcacatagttgccattgtgtatgtgtgtgtgtgtgtgtgtgtgtgtgtgtgtgtgtggtgagacactcaagatgtactgtcttagcaaatttcaggggtacaatccagtattattaacatgctgtccattattcacaaaaggcaagatgaagaaacaatctaagtgcctaaggctggatgaatggataaagaaaatgtggtatatatacacagtggaataatattcagcctta

SEQ ID NO: 348940 - DNA, 831 bp, Homo sapiens
ataatatagaaatacattagctgaatttatactcctgaagccacttcatctttaggctttatatttacagtgttgtccaggaggaactaaagaaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348941 - DNA, 651 bp, Homo sapiens
  misc_feature (1)..(1): n is a, c, g, or t
  misc_feature (4)..(4): n is a, c, g, or t
  misc_feature (11)..(11): n is a, c, g, or t
nctngcagganctgtatgtatcccaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacgttctggggattacgggcgttaccacttgcacccagccttccaagggctttttaaaccataagcttctctacggt

SEQ ID NO: 348942 - DNA, 2480 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348943 - DNA, 3509 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctaattaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaatagtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348944 - DNA, 2933 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtgggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaaataagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348945 - DNA, 2780 bp, Homo sapiens
  misc_feature (2482)..(2482): n is a, c, g, or t
  misc_feature (2691)..(2691): n is a, c, g, or t
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataatnaaaaaaaaaaaaaaaaaaaaaaaaaaaaaaaaaaaaaaaaaaaaacaaaaaaaaaaaaaacatgcggccgaatttggagctcatttgcccatatcgccctatagggggtggttttacatttaactggccgccgtttacacggtggggattggaaatccctggggttaccaaactaaatggctttgaagcaatccccttttgcaagttgncgaattacgaggagcccggaccgttcgcctttccaacagttggccaacctgattgggaatgaaattgaagcgtaatatttgttaaatca

SEQ ID NO: 348946 - DNA, 3962 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctaattaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaatagtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtgggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaaataagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348947 - DNA, 2751 bp, Homo sapiens
  misc_feature (2662)..(2662): n is a, c, g, or t
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataaaaaaaaaaaaaaaaaaaacaaaaaaaaaaaaaacatgcggccgaatttggagctcatttgcccatatcgccctatagggggtggttttacatttaactggccgccgtttacacggtggggattggaaatccctggggttaccaaactaaatggctttgaagcaatccccttttgcaagttgncgaattacgaggagcccggaccgttcgcctttccaacagttggccaacctgattgggaatgaaattgaagcgtaatatttgttaaatca

SEQ ID NO: 348948 - DNA, 3921 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctaattaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaatagattttatgatccaccaagaagattgctgggacagcgaccgggaccatatgatagaccaataggaggaagagggggttattatggagctgggcgtggaagtatgtatgacagaatgcgacgaggaggtgatggatatgatggtgggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaaataagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348949 - DNA, 2200 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcgcttttctcccggcacctgtgttgcccccgcgagcctgtgtatcacccggcg

SEQ ID NO: 348950 - DNA, 3863 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctaattaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtggggatggagagtttgggatggtgttaaatttttatttttgggggttgtgggtcactattgcttaaatgggggggtagccataacatttttctggggtagtttaaaagaattgataattatctaaatttaacttggaaactacagatttgggtggggaattaatgctaatagttaaattaaaattagattgtttccatttctctgtaggatgttgttgataaatgcttttgtataatcacctatttcctttaaaacacctattatgtactaaaagagacaaagtaaaaatatactttatgaattgttttccgtgactaatttctttgtaaaacttaaatatttaattaagtttgtaggtttaaactgttaacttacggtgtatttaggcaatttaaattgggttatgtatctagatatagaaaaacttactgcattttgcccagtatctaatttacactaatacatttatgctgaaacctgtaccttaaaacatttttaaatagtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatggggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348951 - DNA, 2446 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348952 - DNA, 3287 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtgggtatgtgtatctaatgaacaaaggttctgttgtcattttcttaatgttcctgacactttgtcaagaaatacagaaatggcagtaatttcagtacctattaggttttaaaacctgttcatgaaaatacggattcccatggctagctgtgggacttgactgatgcacatattggcacctagaaaacttacacagaaattaaaaataagatgttggcatattttgacctttttttgcctaaggatgaaatttaatttacatgtctgaacttaattaactttctgagattttaaatttccatcacgttgactgcttttttcataggttttaagttgggaattgcaaacttgcaatcaagttacacagactgttaccacaaaatgtttttgtaaactaaattataaaatttatctctggaaagtgtgtagtcatgtgtttctccttaaattacacaggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatggggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348953 - DNA, 2384 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348954 - DNA, 2606 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatgggtaagtatctctagttcagtttgtgttagtccgcatatgtagtgcaaactttaaagtgcaggtattacttttattattttatgcagatatctcctgctgagtgattcttaatatctttttcttaagccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348955 - DNA, 1634 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatcgcagatactgcgatatcatactcgccctctacgaacgcgcacacatccaacttgcttacttcata

SEQ ID NO: 348956 - DNA, 2731 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcgtaagtggtgtctttggcacacaatcttatttcctaaacgtgaatttataaaataagaggctctaagatctgtaggtaacgcttggcagttgttgggatttaaaaccatttgacctctataatggctttctgtgggctttatatatcgctgtactagtaattaataagcatactttgtttaatattacttaattgatcttttttacaaagcttgtattgatgaattttatccatcattcctttctcccctgttactctttctttttttcttaaagaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348957 - DNA, 1309 bp, Homo sapiens
  misc_feature (1270)..(1270): n is a, c, g, or t
  misc_feature (1273)..(1273): n is a, c, g, or t
  misc_feature (1276)..(1276): n is a, c, g, or t
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatgactnagntgntgactcaggtggtgtggggtaccgagctaagtg

SEQ ID NO: 348958 - DNA, 1233 bp, Homo sapiens
  misc_feature (1224)..(1225): n is a, c, g, or t
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatgatcagttgacgaagggggatgacacggatcctnngagtcacc

SEQ ID NO: 348959 - DNA, 1184 bp, Homo sapiens
  misc_feature (1175)..(1176): n is a, c, g, or t
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtgttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatgatcagttgacgaagggggatgacacggatcctnngagtcacc

SEQ ID NO: 348960 - DNA, 3004 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaaggtacctctagtattagtcaaagtttagtagtattgtaattttatatttgtattgttttactgtttttaatttgtaaaacccatttgattttggaacttttaagtttaactatgatagtcttggttaatgtattaaaataatatgctccagttaatattcaatacagaatgtgtagaatatgtaaaacctaattaatgtgcagtaacatatttgagaattgtgatgaaatgaaccgtgaattagtatatggagcatatatttgattttgtagccttttttcatgtaatataggtgggcttttagagtgtgtaattacacagtgtttttacactggtcgcaaaaaatttatttaatccagtaatatttgaaaaaatctttcatttgtattatggggtgatgggaaactaagcttttttgttttgttttgttttgtttagacttgttttaaatatttgattcagatgggaatgtttcagcctttaacactgttccccttgatggggttatttgtccttgggttaaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348961 - DNA, 2547 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataaaaaaaacacaggggggggctaaaaatcctgaggggcaagtagcgaccattcctgtcaagggccaagg

SEQ ID NO: 348962 - DNA, 2431 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtgttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348963 - DNA, 1800 bp, Homo sapiens
ggtcggtccttgcagcgattacaggaagagggggtattatccgagctgggtagtggaagttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348964 - DNA, 2478 bp, Homo sapiens
  misc_feature (2394)..(2394): n is a, c, g, or t
  misc_feature (2397)..(2397): n is a, c, g, or t
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggctttttgtaaaaatggaaaatgggtttgaanganaaaagcccacgcattcctccccacactcatggcccttaccacgctactcctacctatctccccttttatactaataatctt

SEQ ID NO: 348965 - DNA, 2426 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaatcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348966 - DNA, 2685 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatggggtatgtaaagtttttaaaatatgcagggttagctgcttatcgatgagtctcaattttttttcttttttctttttaaagataatcagggaggctatggatcagttggaagaatgggaatggggaacaattacagtggaggatatggtactcctgatggtttgggtggttatgggtaagtatctctagttcagtttgtgttagtccgcatatgtagtgcaaactttaaagtgcaggtattacttttattattttatgcagatatctcctgctgagtgattcttaatatctttttcttaagccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348967 - DNA, 2208 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatgggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcaatgtgggagataa

SEQ ID NO: 348968 - DNA, 1313 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacatcgatatattgaactcttcttgaattctactcctggaggcggctctggcatgggaggttctggaatgggaggctacggaagagatggaatgggtcgccggtgcggggtgggtgctgcgggcgctgcctgttcccgatggtgtctttgatgcttgggctgatgcaggtctcggttcctctagcttcaccttcccagagccgacttcctgagtcaggtacgtgcgtcggtggac

SEQ ID NO: 348969 - DNA, 1155 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtggaagtatgtatgacagaatgcgacgaggaggtgatggatatgatggtggttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactaaatccaatacgagttcatattgatattggagctgatggcagagccacaggagaagcagatgtagagtttgtgacacatgaagatgcagtagctgccatgtctaaagataaaaataacatgcaacgttctggggattacgggcgttaccacttgcacccagccttccaagggctttttaaaccataagcttctctacggt

SEQ ID NO: 348970 - DNA, 974 bp, Homo sapiens
catttacattttgtaaaataaacaatgttaacccgcatctatgtgtatgtggcagggtttcctcaacctcggcattattgatatttggggctggacaattctttgctgtggagactgtcctgtggactgtagtttagcagcatctctagcttcagagaagggagaagtcgtttgcctcgtgtagcgctcgccacaacggttctcccaaccgtctccagcggtgacaaccgcttagggagctgcgcagcaccagagtcggcgtaactatcgcctgacaggcatttaaatcaaacggtattgagatggattgggttatgaaacataatggtccaaatgacgctagtgatgggacagtacgacttcgtggactaccatttggttgcagcaaagaggaaatagttcagttctttcaagggttggaaatcgtgccaaatgggataacattgacgatggactaccaggggagaagcacaggggaggccttcgtgcagtttgcttcaaaggagatagcagaaaatgctctggggaaacacaaggaaagaatagggcacaggtatattgagatcttcagaagtagcaggagtgaaatcaaaggattttatgatccaccaagaagattgctgggacagcgaccgggaccatatgatagaccaataggaggaagagggggttattatggagctgggcgtgttatggaggttttgatgactatggtggctataataattacggctatgggaatgatggctttgatgacagaatgagagatggaagaggtatgggaggacatggctatggtggagctggtgatgcaagttcaggttttcatggtggtcatttcgtacatatgagagggttgccttttcgtgcaactgaaaatgacattgctaatttcttctcaccactagaataggaatggcaagacaatttttaatccatatgattttagtcgagccatttagagttttcttaca

SEQ ID NO: 348971 - DNA, 989 bp, Homo sapiens
ggattctaacatattttagcctagtgcagtggttctcaaccaaccagagtgattttgccgccccctgccccgggaacagttggcaatgtctggagatgttgtttgtcacagcttaggggcagggagggaggttgagaggttgctgctggtatctagtggttagtggccagaggtcctgcttagcacctgcagtacacaggctcccctgttcccagcagagcaagatccacgcagtcaggagtgcggaggctggtggttcttaggtgacaagagccacctggggacctgcctcagccctgaaagagtagcctccacccaccagatgattcccgtcttcaggcctggagccactgtgtcagcttctgttgcacattttgatcttatgttctcttttgagtttgatttacttagaccaagaactgtagaatcatatttttagttgttggctttttcccctctataaatattatgaggatattcttttttttctcaccatttttaagaaaaagaacttcttgaatcactaccccttagcaagctgtgtaatgaagaacaggaattgctgcgttttctatttgagaacaaattgaaaaaagtaagtaaaaccaaagagttagcacttgctttatgtaaatatcttattccataaaatttggcatctagtcttatattaagttttcaaaattaaaactttttaaatttagcacatttttaagaatagagcgtttaagatacataagattccaaaaatacaatccctgggcggcgtttacacgtcgtgactgggaaacctggggtaccaagtaaatgcttggggcatccccttcgccagggggtatagagccgcgatgcctccccaatgcgcgcagggaggagcactgccccaactcggaagccgacaaggggaacccattccagggaaggggccctcaccaggggggtggtgagcctaagaactggagaaggaggaccacgttcggcgtcacttg

SEQ ID NO: 348972 - DNA, 614 bp, Homo sapiens
aggtgaggtgctttgctgtatcctctgcagtattcgggaagtgctgtcttagggggtgtctgttcccaccttgcccacagtgtgtccttcatctaactctccagttagagagttaattttttatctagaaggaaagacaagtatgaaatcattgctgtaagagcagaattatatgattgtgaagagttgtaatgaaatcatgtcttaaattacatgtgatacgaacaattgttctttttctgctttttcctgaacagaacttttctatctttctcataaactggtggatttatatcctagtaatcctgtgtcttggtttgcagtgggatgttactatctcatggtcggtcataaaaatgaacatgccagaagatatctcaggtatgaatttatttttttcctctctagttaacctgtagaattgatgtcttgctcataagctttcaagtagtaattagtgagtactttaaaagcaatgtgaaagaataaatgtttttttttttcttcctttcttttctttctctctttctttcttgccttttcttttccttctcacctcccctcccctctctctcgagggttctcactctgttgcccagactagagtgcagtgg

SEQ ID NO: 348973 - DNA, 2330 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348974 - DNA, 2599 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatcaaaaaaaaaaaaaaaaaaacaaaaacaccaaaaagaaaataaaagaaaaaaaaagacaaaaaaaaaaaatgagaacaacaaaaaaaataaagcgagacacgaccaccaaaaacacacagcacgaaggagggggaggcgtacgatgatgagcagcccggctggaagaagtcgagcgtagcggctgatccgaggaaggggcagagcccgaggaaggggaatacggagatgagtaggaaagaggggggagaggtaagagggtaggagatagtagcaagggtgcatagaaaggaaacaaaatggtgggacagtaggcggcacccccgtaggagacggagtgaaaaacagaggggggggcgaggagagtaggagaggaagacagagttgtaatacagcggtagaa

SEQ ID NO: 348975 - DNA, 2177 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaaggatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348976 - DNA, 3260 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaagtaagtgaagtagagcattttcagaaatatactttgtgtctcaaagtttacttaattttgaatactttgtcatattcttatttcatgagatcaaccagctttcttgtacttggctgctcagataaaatcagcatcaaatcagtttttattatttatctgtgttggtgtaattttattttagaaacacattgagaattttacttttttatatgaaaatttagtgttcaaaattaattcagaagaattaggacagtaggatataattaaaatcctatccatagtctgttttctgctagaggttttgtggtgtgataaacaggcgacagttgaaaaatgggttttttggttaaatatgtctgggcaattttaggttattcaagatttaacaagtatttctattgcaggatttctttgagtctttactatgtattacgaacttatagcattttccaaagtttaattgagcataaaacatttttttcacaaaagactttacaagtcaagtattccagagaactttaaggagcacttttctaagtaaatcttttggaccttaaagcgatactccttgactgcttttatctacccctgatatgggacactgactgtcacctaagagggtggtgtgtggtaagggcacagccaggaggcatggattaggttctggttgcagtgtcccactgaacatcaaaaggaatacagcagacatccctgcaggagtgcccttggccggcggagggagtgggcctggaagatgcatttagagggcatattgagatgcatgagagtaggtgtggagaacattcaccagtctagactgctgttctcattgagacagcgtttcttgggtgttgatatggatggttgctcatcttagacttaggaatttagtgcttttactgtagccaataattgtgttctctcccacagaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348977 - DNA, 2370 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccataagtcgtgagtgatgagcggcacttctgttttccacgtagtatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348978 - DNA, 1706 bp, Homo sapiens
caccaacctaataggatttcctgttggttttgattcttttaaataagcggcctacttattttatgtattacaattctgttgacttaaagtaaatgtatgtgataatgtttatttttattcctttcaaataaaccagaattttttctttcatttgtaacttaattatggccttaactgaatcaacctgaagataatggagtgaagaaagtgaagtgttacaacccacagcatcatatgtgataccataatgactgtctacacatagccgatcgtcgtgagtgctgtcacctgctggtttgggggtagtaatgtgtcgctttaactttcagagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348979 - DNA, 2388 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgcacctaactggaaatgactcaaacgtccaccagtaggagagaggagaaataaattgtggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348980 - DNA, 2239 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348981 - DNA, 2304 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggatatttgaatgggttatccacgacgattaacatggatggcctt

SEQ ID NO: 348982 - DNA, 2268 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccactatgtataactattttgtaggttcagagaatcagaacacatctgttgcaaaggtgtgcgatccagtctcttaaggcgggtctctgttcctaaatgtagagatgcagtttggaggtcga

SEQ ID NO: 348983 - DNA, 941 bp, Homo sapiens
atttgagtattgtataatttacctttcttctgagatctgattaatacagaaggcactgcgcccagtcgagatagaactttttaaaaaatcttttttggggtagatttccagcataagaaaatagaatagtgtgatgaacctccatgacccataaccaacttcaacaatctttggttcatggccagtcatgtagctatgtctggccacttcccccaccctggatgccctggaatattttgaaatgaatcagtgtggtaagagaaggaaatatgttttcttttaataaccatgctgaatcttttatggcaggcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348984 - DNA, 613 bp, Homo sapiens
ttttttattttatatatatttttctgtattttgtctttcgtgttttgacaaactaggtacagtacttaagcagagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348985 - DNA, 355 bp, Homo sapiens
actttagacatttcacatttaaataatgggcatagtatatgttatcctttaaaaattcggatcatgtgtttcgtgttagaagtcgtgagtgatgagcggcacttctgttttccacgtagtatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcagtaagtagtactgtgagcacagctcagtaacggcggcgagaattgccctcattacgtggcagaaacacattatcttcttttacttattactatat

SEQ ID NO: 348986 - DNA, 1124 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaaggtttggaaactcaggcttttttgttttatgtttagcaaaattaatattgtttggattttttgcctctgaaatcttctaagtcaacaacaggccacatacaggtttaaatagacctactcactttcttaatgtcttcaaatgtaaagcacgttgcagaatgcagtattgtacggtgccttgtgctgtccgaatctagggattgtgataggaagaggccatctttttgagaagtgattgagatagtataaaccaggatttcagtatctcatgcagtgattctcaaccgtgttgctctttacatccttgggaagacagagaaacatccatgtccagttcccaactccagagcagatgctttaaagctcccaggtgatcctaatgtaccacaggcactgag

SEQ ID NO: 348987 - DNA, 2681 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatcaaaaaaaaaaaaaaaaaaacaaaaacaccaaaaagaaaataaaagaaaaaaaaagacaaaaaaaaaaaatgagaacaacaaaaaaaataaagcgagacacgaccaccaaaaacacacagcacgaaggagggggaggcgtacgatgatgagcagcccggctggaagaagtcgagcgtagcggctgatccgaggaaggggcagagcccgaggaaggggaatacggagatgagtaggaaagaggggggagaggtaagagggtaggagatagtagcaagggtgcatagaaaggaaacaaaatggtgggacagtaggcggcacccccgtaggagacggagtgaaaaacagaggggggggcgaggagagtaggagaggaagacagagttgtaatacagcggtagaa

SEQ ID NO: 348988 - DNA, 2275 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348989 - DNA, 2268 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgagaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348990 - DNA, 2106 bp, Homo sapiens
ggattctaacatattttagcctagtgcagtggttctcaaccaaccagagtgattttgccgccccctgccccgggaacagttggcaatgtctggagatgttgtttgtcacagcttaggggcagggagggaggttgagaggttgctgctggtatctagtggttagtggccagaggtcctgcttagcacctgcagtacacaggctcccctgttcccagcagagcaagatccacgcagtcaggagtgcggaggctggtggttcttaggtgacaagagccacctggggacctgcctcagccctgaaagagtagcctccacccaccagatgattcccgtcttcaggcctggagccactgtgtcagcttctgttgcacattttgatcttatgttctcttttgagtttgatttacttagaccaagaactgtagaatcatatttttagttgttggctttttcccctctataaatattatgaggatattcttttttttctcaccatttttaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348991 - DNA, 1625 bp, Homo sapiens
gaagaatagaaaacgcagcaattcctgttcttcattacacagcttgctaagggcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348992 - DNA, 2639 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccataagtcgtgagtgatgagcggcacttctgttttccacgtagtatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatcaaaaaaaaaaaaaaaaaaacaaaaacaccaaaaagaaaataaaagaaaaaaaaagacaaaaaaaaaaaatgagaacaacaaaaaaaataaagcgagacacgaccaccaaaaacacacagcacgaaggagggggaggcgtacgatgatgagcagcccggctggaagaagtcgagcgtagcggctgatccgaggaaggggcagagcccgaggaaggggaatacggagatgagtaggaaagaggggggagaggtaagagggtaggagatagtagcaagggtgcatagaaaggaaacaaaatggtgggacagtaggcggcacccccgtaggagacggagtgaaaaacagaggggggggcgaggagagtaggagaggaagacagagttgtaatacagcggtagaa

SEQ ID NO: 348993 - DNA, 1113 bp, Homo sapiens
gtatcgtgagtgaccctcgtatcatgtgatggctggataacttcacagcagcctgctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggttagtattccttcacatcctctccatggcttaagaatgtcccacttcctaacgtgactccaaactgcatctctacatttaggaacagagacccgccttaagagactggatcgcacacctttgcaacagatgtgttctgattctctgaacctacaaaatagttatacatagtggaataaagaaggtaaaccatctgttatgtctttttttttcttttccaataaacttttattttggactaaa

SEQ ID NO: 348994 - DNA, 2505 bp, Homo sapiens
tgcacggggcctgggtggggggtgcgggtgtgggtggggacctgcggccttcgagtccgcggccttcgagtcctggggcggcggcggcggctgcaggcacgggcacgggcacggggcggggtgcttagggtgcaggaggcgcgcgcctagcggcggagtgtggcgtgaggccgggcccgcgccgccatgaacctagagcggctgcggaagcgcgtccggcagtacctcgaccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattgggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtgactccagtcagtggtcctggtcccactgtcccagtgtaggaacagagacccgccttaagagactggatcgcacacctttgcaacagatgtgttctgattctctgaacctacaaaatagttatacatagtggaataaagaaggtaaaccatcaaaaaaaaaaaaaaaaaaacaaaaacaccaaaaagaaaataaaagaaaaaaaaagacaaaaaaaaaaaatgagaacaacaaaaaaaataaagcgagacacgaccaccaaaaacacacagcacgaaggagggggaggcgtacgatgatgagcagcccggctggaagaagtcgagcgtagcggctgatccgaggaaggggcagagcccgaggaaggggaatacggagatgagtaggaaagaggggggagaggtaagagggtaggagatagtagcaagggtgcatagaaaggaaacaaaatggtgggacagtaggcggcacccccgtaggagacggagtgaaaaacagaggggggggcgaggagagtaggagaggaagacagagttgtaatacagcggtagaa

SEQ ID NO: 348995 - DNA, 2186 bp, Homo sapiens
gggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 348996 - DNA, 2697 bp, Homo sapiens
gggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccacccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaa

SEQ ID NO: 348997 - DNA, 1939 bp, Homo sapiens
gggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 348998 - DNA, 2788 bp, Homo sapiens
  misc_feature (2765)..(2765): n is a, c, g, or t
  misc_feature (2769)..(2769): n is a, c, g, or t
  misc_feature (2771)..(2772): n is a, c, g, or t
  misc_feature (2776)..(2777): n is a, c, g, or t
  misc_feature (2782)..(2784): n is a, c, g, or t
  misc_feature (2786)..(2786): n is a, c, g, or t
  misc_feature (2788)..(2788): n is a, c, g, or t
gggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccaccctgcaccgtccttacggcaatatgcttttgtagcatgtttgactttccaaaacgtttccagcatctttcagatttccccaaccagcccttggggcagtggccctgtgcaaaccttggctcaggaaggagattgggctcgctccacacaccctgtcggcgacgntgcngnncagnncgagnnncngn

SEQ ID NO: 348999 - DNA, 2315 bp, Homo sapiens
ggccacgtgcctctctcacgggcagcacacggacaagagctcggtagtgtcggggaagcatctcggaggagctgcgggagggagcagagtgcccggacagagagagtgtggcaggggaagcatggctggggcctctgggggtcggcgctgcctctcactgatacaggggacgcatgcagaggcagccttggtggtcagtggaggagaatcccaaactgcttgtgcctcattgcgtttgggatgcctggtggacaccaagtggaggtgacatgtgggcagctgaggacagcgagagagaggcctgaagtggagcctggaattctccagacacatgtgccatttagggctctaggattctgtctgcaagggcagccatgagggccgggcacggagccccagacgactccccatggagagacagggagaaaggtgactcagaggaggggagtgagcaggtgcagctgtgggggcgggcagaaccacaggaactcagggtcccgggtgccagaaggggggcgtttctgcacctcagcagctgtggtgagggctgctgaggggtcaagaggaggtgtgggtccctgggcagatgaggccagggtagcacacgcgaggggcagcgggtgtgctgggagaagccggggaggaaggcccagcagtgtttttaacccagctccccagcccagtccttcagaaaggacgagagagtggcgtggagaagcaagccctggagaaagtgtggggatgaacagggctcacagacagaggccgggctgcacgggatctcagagctagggccaggggaggtgggagacaaggccacctgctatagggacagtgcttgggaagggaggatgagagaccaagggttcgcagaaggtgggaacttctggagtacccatgaggtttgtggccctcaatttagagtaaatgtgggcatctccctccagccacactgagctgcacaggtacaggcaggagaaggtggacaggtggggtcagtagatggggtggccaggggggtggcagagtgtgaggatttctcatggctcccgagaggctgccaggagctcgctgagcgtggggccctgtaaactgggagctggactatccgccccggggtgacctggagggagggcagctacatcagtgcaggctgcagcaccgggacccttctgcgccctcagcaagtgggtagcacacaggaggggtggcaggtgtgccgggaagggctgtggcccagtcctctctggcccaacacggccacctcacctgccggcattcttcacaaagcccaggtcagccagctccacatcacacagctcgcagcggaagcagcccgggtgccagttgttgttcatggccttgatgacgcggccaatgatgaactcacctggaagaagacaggtccctgctggctggggagcacgtgcctgtcccctcttcggaccctcccaagccctgtccacctagcactccgcctgctctctgcctggcccatgggctccctcgtgggatggtgatgcctgtagggggcctgacggctgccgctcagagaggcaaggtggggagttaggaaagagctgggccagttctgtgtaccccctcggccccctgccccccgccactgctgcccacttcccaggcagcccaggatgtgtactgtcaccggccttaccgcaggatccacagcacggagcaaacagcatttggaagtcgtgttcgcagtacttccggccttcaaactgcaaaggggtcgcagagagaggacaagcaaaccacctatcatccccatgagcagcccaggcccttgttgggtcaggacctgacagcaggggatgaggcactgaggcaggggcatgccgggctgaggctggagcagtgggtcccaggcctggccagagaggacactggcccttttgggatggtggggtgcaaagggaggtgcccccgtggaagctggagaggtccgtgaggccacctgtcaaagggccactggtgtctactgaggatctggaccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaa

SEQ ID NO: 349000 - DNA, 1783 bp, Homo sapiens
ggccacgtgcctctctcacgggcagcacacggacaagagctcggtagtgtcggggaagcatctcggaggagctgcgggagggagcagagtgcccggacagagagagtgtggcaggggaagcatggctggggcctctgggggtcggcgctgcctctcactgatacaggggacgcatgcagaggcagccttggtggtcagtggaggagaatcccaaactgcttgtgcctcattgcgtttgggatgcctggtggacaccaagtggaggtgacatgtgggcagctgaggacagcgagagagaggcctgaagtggagcctggaattctccagacacatgtgccatttagggctctaggattctgtctgcaagggcagccatgagggccgggcacggagccccagacgactccccatggagagacagggagaaagaaccacaggaactcagggtcccgggtgccagaaggggggcgtttctgcacctcagcagctgtggtgagggctgctgaggggtcaagaggaggtgtgggtccctgggcagatgaggccagggtagcacacgcgaggggcagcgggtgtgctgggagaagccggggaggaaggcccagcagtgtttttaacccagctccccagcccagtccttcagaaaggacgagagatgggtagcacacaggaggggtggcaggtgtgccgggaagggctgtggcccagtcctctctggcccaacacggccacctcacctgccggcattcttcacaaagcccaggtcagccagctccacatcacacagctcgcagcggaagcagcccgggtgccagttgttgttcatggccttgatgacgcggccaatgatgaactcacctggaagaagacaggtccctgctggctggggagcacgtgcctgtcccctcttcggaccctcccaagccctgtccacctagcactccgcctgctctctgcctggcccatgggctccctcgtgggatggtgatgcctgtagggggcctgacggctgccgctcagagaggcaaggtggggagttaggaaagagctgggccagttctgtgtaccccctcggccccctgccccccgccactgctgcccacttcccaggcagcccaggatgtgtactgtcaccggccttaccgcaggatccacagcacggagcaaacagcatttggaagtcgtgttcgcagtacttccggccttcaaactgcaaaggggtcgcagagagaggacaagcaaaccacctatcatccccatgagcagcccaggcccttgttgggtcaggacctgacagcaggggatgaggcactgaggcaggggcatgccgggctgaggctggagcagtgggtcccaggcctggccagagaggacactggcccttttgggatggtggggtgcaaagggaggtgcccccgtggaagctggagaggtccgtgaggccacctgtcaaagggccactggtgtctactgaggatctggaccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaa

SEQ ID NO: 349001 - DNA, 824 bp, Homo sapiens
gggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcctctctccgcctgagctatttcccttgctagtgtgcagatatttccctaacatgtccttttttgtatttgtttgtacggaccataaatataactgtagctttaagacta

SEQ ID NO: 349002 - DNA, 604 bp, Homo sapiens
caacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggtaaggggcaggctgggtggggtggactgggagcccagggctaagcagaggaaacactcagcggggagccctgcccagggagacaggcagcagcctgtctcgtcccatctctttggtgatggtctgacctgtgcatcgaaggctgaccacagtctgaattcacagcagcccacaaagcggtgtttcgtccctctgatgggggcttgcagaggggaagtggcttgccggcagtccaggctgcaatgacagcaccgctgcccctaaccattaggcagccttgacccatagaggagccagatgcctgggagagggctcgggccagggatggagtggcgctaatgcaaaggaaactgccaccacctggccatggcgctgccaccacaggccctccccgaggccacacatgcccacct

SEQ ID NO: 349003 - DNA, 2584 bp, Homo sapiens
  misc_feature (2561)..(2561): n is a, c, g, or t
  misc_feature (2565)..(2565): n is a, c, g, or t
  misc_feature (2567)..(2568): n is a, c, g, or t
  misc_feature (2572)..(2573): n is a, c, g, or t
  misc_feature (2578)..(2580): n is a, c, g, or t
  misc_feature (2582)..(2582): n is a, c, g, or t
  misc_feature (2584)..(2584): n is a, c, g, or t
gggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccaccctgcaccgtccttacggcaatatgcttttgtagcatgtttgactttccaaaacgtttccagcatctttcagatttccccaaccagcccttggggcagtggccctgtgcaaaccttggctcaggaaggagattgggctcgctccacacaccctgtcggcgacgntgcngnncagnncgagnnncngn

SEQ ID NO: 349004 - DNA, 2251 bp, Homo sapiens
gggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggatgtccaaacggagttggtgggctggatccagaaagcccccaagagagatgctgaaactctcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagacta

SEQ ID NO: 349005 - DNA, 2813 bp, Homo sapiens
  misc_feature (2790)..(2790): n is a, c, g, or t
  misc_feature (2794)..(2794): n is a, c, g, or t
  misc_feature (2796)..(2797): n is a, c, g, or t
  misc_feature (2801)..(2802): n is a, c, g, or t
  misc_feature (2807)..(2809): n is a, c, g, or t
  misc_feature (2811)..(2811): n is a, c, g, or t
  misc_feature (2813)..(2813): n is a, c, g, or t
gggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagagctctccgccctcaccgtggttttagcagtcctagggaaagtgccagccgagaccagccagaccaagtcagagtactgtggaacctggattcctggggaatggggtccccatgaggaactccacattggactaagaacagaccctgttcctggaagcagcaggaaaccatctctggtgttagaacttcaggcatcttgaaacactctgaagccgggggcaatcttttcaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcccctctacgcacacctggcctgtgccttcctgtgggtggtggtggctgtggccatggccccgctgctggtgagcccacagaccgtgcagaccaaccacacggtggtctgcctgcagctgtaccgggagaaggcctcccaccatgccctggtgtccctggcagtggccttcaccttcccgttcatcaccacggtcacctgctacctgctgatcatccgcagcctgcggcagggcctgcgtgtggagaagcgcctcaagaccaaggcagtgcgcatgatcgccatagtgctggccatcttcctggtctgcttcgtgccctaccacgtcaaccgctccgtctacgtgctgcactaccgcagccatggggcctcctgcgccacccagcgcatcctggccctggcaaaccgcatcacctcctgcctcaccagcctcaacggggcactcgaccccatcatgtatttcttcgtggctgagaagttccgccacgccctgtgcaacttgctctgtggcaaaaggctcaagggcccgccccccagcttcgaagggaaaaccaacgagagctcgctgagtgccaagtcagagctgtgagcggggggcgccgtccaggccgagcgcagactgtttaggactcagcagacccagcaagaggcatctgccctttccccagccacctccccagcaagcaacctgaaatctcagcagatgcccaccatttctctagatcgcctagtctcaacccataaaaaggaagaactgacaaaggggatccatcggccacccctctgcaggggcttgtgatggctacaatggctcctagacactcaacgacttcatctgtggcagggagagaggaggccggaagaacaacccctgaacaatggaggcctttctttcccgctaggctcccagcctccttcccgctacagaatcgctcatcggcgaggctcagcagaaagaccctgaaggcaggctgcaaatgacccagaagagggacctgggagtcctggtggggacggggagggagtctcaatactcctttgcagtgcaaggtactctgagtcccctctgtagtgcctctgccagacacacactgcctgagttgaagagacacaggccacacatttcaggctggttgccagcggacgtcagcactcacggcctgcagggactcagcacagctctggattctggatctctcctgctgtaaccccacgcacaagcctgcaacccccagagctctttgacaggctcccaggcctcccagtcctggacaagcatgtgcagtcacgggagctcagctcaggccagggctgggctgtgcacctgcctcccactgacccagacccacttcctccagagaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccaccctgcaccgtccttacggcaatatgcttttgtagcatgtttgactttccaaaacgtttccagcatctttcagatttccccaaccagcccttggggcagtggccctgtgcaaaccttggctcaggaaggagattgggctcgctccacacaccctgtcggcgacgntgcngnncagnncgagnnncngn

SEQ ID NO: 349006 - DNA, 1335 bp, Homo sapiens
gggctagggacacactagaatattcacgctccggtggcagcagcagcagcagccagaggagcagcccgacacaacaagggacccctcaggaatgaagcagcctttcagggccagaggggctgtggtctcccttcctctccttaaatagccagcgttccacccacagcggcaaggagccccctgccaccaccgacacccacgggcggagatcacctgctgccccgcagacccctgtcccttcctcccggaccagcagctagaggctctgactccagccaaagcatgaatggccttgaagtggctcccccaggtctgatcaccaacttctccctggccacggcagagcaatgtggccaggagacgccactggagaacatgctgttcgcctccttctaccttctggattttatcctggctttagttggcaataccctggctctgtggcttttcatccgagaccacaagtccgggaccccggccaacgtgttcctgatgcatctggccgtggccgacttgtcgtgcgtgctggtcctgcccacccgcctggtctaccacttctctgggaaccactggccatttggggaaatcgcatgccgtctcaccggcttcctcttctacctcaacatgtacgccagcatctacttcctcacctgcatcagcgccgaccgtttcctggccattgtgcacccggtcaagtccctcaagctccgcaggcctctctccgcctgagctatttcccttgctagtgtgcagatatttccctaacatgtccttttttgtatttgtttgtacggaccataaatataactgtagctttaagactacacaggttgttatgtttggtcaacatgaagcgtttcccagaacttctctgacccaagaatggtgaagtggtggtacagtggcagaggcagcctcgtgggctctcttgctggggctctggcagctcacagcacatctgcccagattctgaggttctgcactgtggggctgggagggccaagtaggggcctcattcctcactctagctgccacccctgttggtccggagaacaggctgggggcgaggcggttttaagccaggagggatgagatccagtctgaagtgtagtgtcacttggtcctatttcgtataccttctctgtgggagtatccagctctctcagaggccatgaagacccgggtataggagacagaaggaagggaacgcaggaagggcctgggcacggggaagtgggaagagctcagggctgcggccagcaggagccagtgtgcacaccctccaggcggcagctgccagcgagggcccctgtgctggccacaagcggggccaaa

SEQ ID NO: 349007 - DNA, 548 bp, Homo sapiens
ggccagaaagaccaaaactgtatcctgaggtttgagtttctgagccaggtgatgtcatcctccagcttggccggcctctttctgggagcctctggtgtgaaagagagcagatttattaaaaatcatcaacttcaaattatttggatggaaacattgccaaatcatagagatgtttgctaccacccgcacaccaagcagctgggtaactagaagtgcaggatcagcttattcacctccgaaagcctgcatgcaaccactgaggccgcctctattttttacatagttctacttggtgtatgtaaccccacagagaaacctggaagaatgcatgaaacctagtaaggcaaccagcacatgcaacagaatgaaccgtttctttccatctgaatgcctaaatgtggactctgatcctttctaccaagtcctaagtttgggaaaagaggacaaggacaggggctctgtcccatatcataatgtgcttgtgaatggctaaaattacaatgctgagataagtgtgtgtaataaaataattgcaccccgaattgaaa

SEQ ID NO: 349008 - DNA, 583 bp, Homo sapiens
ggccagaaagaccaaaactgtatcctgaggtttgagtttctgagccaggtgatgtcatcctccagcttggccggcctctttctgggagcctctggtgtgaaagagagcagatttattaaaaatcatcaacttcaaattatttggatggaaacattgccaaatcatagagatgtttgctaccacccgcacaccaagcagctgggtaactagaagtgcaggatcagcttattcacctccgaaagcctgcatgcaaccactgaggccgcctctattttttacatagttctacttggtgtatgtaaccccacagagaaacctggaagaatgcatgaaacctagtaaggcaaccagcacatgcaacagaatgaaccgtttctttccatctgaatgcctaaatgtggactctgatcctttctaccaagtcctaagtttgggaaaagaggacaaggacaggggctctgtcccatatcataatgtgcttgtgaatggctaaaattacaatgctgagataagtgtgtgtaataaaaacagatgcgggccgctcccgccccgcgtccgcacatcctcgggcagactctggata

SEQ ID NO: 349009 - DNA, 875 bp, Homo sapiens
ttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcaggtgaggaggccgcgggacattttggggtccccattcttcacagaggttggtgactgagcctgtggcacttggcgtgtcagctccatcctttcccctcctgaggcggggaaagagtgtccaggtgtctggagacgtgggctccttgctctaattctgc

SEQ ID NO: 349010 - DNA, 3068 bp, Homo sapiens
ttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacacagcacacacacacagcacacacacacacacacacaagatctgggcccttaatgtttacagtccagcaggaaatgttaccctccattcagtatacgcccccttgttatctagacctgtcgggactcatctaagatatgtacgctgaaacccaaggagccagctagaaagaacgcttgatgattagatgtacaatacatcgggggcagaagatctgggatcaattaagatggacgcctgaaggactatggaatcttgcgtgtcaggaatgggcatgtctacttcctgccatctctgaaagccccgcgggaccagcttctaggctgaatctgtctagtaggcgtgaagcttcaggactctgcggtcaaggatatgtgatgagcagccggctaagtgtggctcttcagattcctaggtagcacaagactttatcagaatctataggcataccaatctggatcacctcttccaaccacaagcgaggaatagatgcctctgaatcttcatatcggtatatttaagtcaaaagatggtccggggtggccctcaacaaagcgttgtgcatccacgtggtaaagctccag

SEQ ID NO: 349011 - DNA, 3968 bp, Homo sapiens
ttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaaggga

SEQ ID NO: 349012 - DNA, 3355 bp, Homo sapiens
gggcaaggctggatcatgcacgagacgcgcttctggggattctgtagactggagtgctggcctgtgggcgttggctctggccgtcgtattctcttgctcgctgcactggtgaaatcctggtcgggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaaggga

SEQ ID NO: 349013 - DNA, 2370 bp, Homo sapiens
ttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaaggga

SEQ ID NO: 349014 - DNA, 862 bp, Homo sapiens
ttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtccttccctccttccagctgtttctagttaccacctacccctggccgtggactgatcagaccagcattcaaaataaaagtttgttccaagttga

SEQ ID NO: 349015 - DNA, 479 bp, Homo sapiens
gaaaaccactgtcttcggcatgacaggccatctgcctgacttctgcatgctcatggtgagtgggaggcgccccaaggaggggaggcgtcagcagggctgcttgggtctggttatgtgcaagtctgaaactgttctgagactgaggcctgttggtttggggctttgacatcgggtgaggctggcgagttttgcaggggtgcccagtcctctgagtaatggtcttctcaaggcttgaaccttgatctctcccttacattagactagggaaggtatcctcttggtaaaaaccaggtacccttgaagacctgtcttattttttgcagaggcatagaggagggtttctcctgggccttacttgttaccttcagaaatgttttctgcagaggattgggctactttgaggaggtgacaccaggtaggtagtaccttcagaggggcaggcctggggaagaaacggagaagacagccataggaggcac

SEQ ID NO: 349016 - DNA, 357 bp, Homo sapiens
tgcctgcctttgcttcctcatgcgtccttcatggccgagcagctgaagtgctgattcccgcatgaagccttcctgacccccagtagtagtgttgagtcttcccatggagcactgagggtgctcgtgctgtccaccctagaaggcctgtggtccagttggtgaggaaaccaggcagagttggggtggtccctatccctagaaagactcttggtccctgggaccaggggtgaaaccagaaggcataattgtccctgagggctggggctccctctttctttcagatcaagcgctcgtccatccggaagggcatggtgatggtttccccacgtttgaatccccaagcctcctgggagtttg

SEQ ID NO: 349017 - DNA, 3781 bp, Homo sapiens
ttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttga

SEQ ID NO: 349018 - DNA, 4080 bp, Homo sapiens
ttgggatttgggcctcattaattattcattaggtacttgaaagctctgcagggattggtggctgagaggcctagtcgactgtttcttagctagaggtacgtgtcacccagtacgcggctggagttttgcataaattattccgataaggagcggggcggggctctgtgcatagattagtcaaatgagcctgggagggagggaagccggctacgaattagcctaagttattaaagatggcgacggagcgcagtcgctccgcgatggactcgccggtcccggcctctatgttcgcccccgagcccagctccccgggggcggccagggccgcggcggccgccgcccgactccacggcggctttgactcggactgcagcgaggacggcgaggcgctcaacggcgagccagagctggacctcaccagcaagctggttctagtgagccctacatcagagcagtatgacagcctacttcggcagatgtgggagaggatggacgagggatgcggagagaccatatatgtcattgggcagggatcagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaaggga

SEQ ID NO: 349019 - DNA, 4122 bp, Homo sapiens
gtcacccatgctgctcctcaacacactgagctgcttcctggtccctgaacttgccatgatctgccacgccacgctttgttcctctggctaggatgtccttcctccttctgcaggcccagcacttgttgacctagcttggcatcagccctttgcagaactgtcctcggcttccccaggcagtgctttatgttctcttcacacagtcctagagtgcagcacttgagctgtattgcaattaattaatttcctgtctgcctcccccactgggctgtgagctcactaggggcacctgtagtcctagtacccagcatgaggcttggcataaaacctgggagagcctcggtggctgttgttgaatgaagtagcgaatgctctgcttgatggagaggtctgtggcactgtcatgttttaacttggtgtgtgcccaggttttctctcaggtagagaggacccctgttcctctgcagtgctggggtcggggggtggtggcctttgttaggtggggttcctggctggctggttggcaggctggttggtcaggactccctctcctgctgatgtctgggctcttgtcaccagatgggactgagtatgggctgagtgaagctgacatggaggcctcctacgccacagtgaagagcatggcggaacagatagaggccgatgtcatccttctgcgggaacggcaagaagctgggggccgcgtgcgtgattacctggtccggaaacgagtaggagacaatgacttcctggaggtcagggtagcagtggtgggcaacgtggatgctggcaaaagcacgcttctgggggtcctgacacatggggagctggacaatggccgaggctttgcccgccagaaactcttccgccacaaacatgaaattgaatctggtcgcaccagcagtgtgggcaacgacattctgggctttgacagtgaaggcaatgtagtgaacaagcctgacagccacggcggcagcctggagtggaccaagatctgtgagaagtccacgaaagtcattaccttcatcgacttggctggtcatgagaagtacctgaaaaccactgtcttcggcatgacaggccatctgcctgacttctgcatgctcatggtgggcagcaatgctggcatcgtggggatgaccaaagaacacctgggcttggcactggcactcaatgtacctgtctttgtggtagtcaccaagattgacatgtgtcctgccaacatcctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaaggga

SEQ ID NO: 349020 - DNA, 2957 bp, Homo sapiens
gacgctctctgtgggggcaggcaaccagctgcgtcagcaatctccagcctcagcctaagccctgcaagaaaccctgaagctgttacagcgcctgctgaagtcaccaggctgccggaagatccccgtgctggtgcagagcaaagatgatgtgattgtcacagcctccaacttcagctctgaaaggatgtgcccgatattccagatctccaacgttacaggcgagaacctagatctgctgaagatgttcctcaacctcctctccccccgcaccagctacagggaggaggagcctgctgagtttcagattgatgacacctactccgtcccgggtgtggggacagtggtttcggggacaacactgagaggcctgatcaagctgaatgacacgctgctgctgggcccagaccccttgggtaacttcctgtccattgctgtcaaatccatccatcgcaagcgcatgcctgtcaaggaggtgcggggtggccagacagcatcctttgcgctgaagaagatcaagcgctcgtccatccggaagggcatggtgatggtttccccacgtttgaatccccaagcctcctgggagtttgaggccgagattctcgtcctccaccaccccaccacaattagcccgcgctaccaggccatggtgcactgtgggagcatcaggcagacagccaccattctgagcatggacaaggactgtctgcgcactggggacaaggccactgtacacttccgcttcatcaagacccctgagtacctgcacatagaccagcggctggtgttccgggaaggccgcaccaaggctgtcggcaccatcaccaagctcctccagaccaccaacaactccccaatgaactccaagccgcagcagattaaaatgcagtcgacgaaaaagggccccctgacgaaacgagacgaggggggcccgtctggtgggccagcagtaggagcacccccacctggagatgaagcctcctctgtaggggcagggcaaccagctgcgtccagcaatctccagcctcagcctaagcccagcagtggaggccggcgacgagggggccagcgccacaaggtgaagtcccagggggcctgtgtgactcctgccagcggctgctgaaccttcccctggcccaccctcaccacccaaggggtcatcatctctggccaccactccaccagatgggcagagcagctatgaccgccacccagccctcccgctcaggccacagccggagcctccgcattgcccccacccccattttccaggggggttgtaatttataagctgacgaaggtagccagacttccggaggactgaccatctctcactgtcctccccaccttcttcctcactcacacattttttgtacatctgggcccttagtttttattctgtttattatatgtctctgtctctctctattgtgtgtgtgtgtgtgtgtgtgtgtgtgtgtgtgtgtgtgtggtgcaggagtgccacccccagggccctgtcaacctctcttttctcctccatggctgtctgcctgcgtatctgtctctgagaatcctcggggcggtcaggggatgtcaggaggggaaggagccgccctccctatcttgctgctcctcttggcactcaggggcaccttccatggagccagaccgggtggaggggcttctgggatttggtgtctgctgctgccagagcaggaacccccagtctaggacttgggcattttaacagggagaaagtagtggcttcccttttctctctctcctcctttttccctttaagcccacagattcaggtcatgccaaaagctctctggttgtaacctggagacatgtggaggggaatggcgatgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaaggga

SEQ ID NO: 349021 - DNA, 1177 bp, Homo sapiens
  misc_feature (10)..(10): n is a, c, g, or t
ttaaggcaancaagggccggcccaggcaaacgcaggattgtctccaaggggaaacccaccagctgtcttgggattataggactctccccatctcgggccctgaccctgacccttgccaccaacccaaagacagctggtgggtttccccttggagacaatcctgcgtttgcctgggccggccctggctgccctcagctttcgctgatctgcccggcctggagcctcccatcaccccgcttcttgttgggcctcaggcactggttaccagaagggggtctgggtctgctcaggatcatgttttgtagcacctcctgttggaggggtggagggatgttcccctgagccaggctgagactagaaccccatcttccctgagccaggctgagactagaaccccatcttccccaccacgccacccctgtggctgctacaggagcacagtagtgaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgacagtgtggtgctccctgcccagcccctccaggtggaggtgctgccacgggaacgcagttgctctgcctgccctggggcccctggcgacagctgggagcagggcagtgctgtgaggagcccagctttcccagtcaggcaggcatggcttccgtgttcaggctccctcaccagctggtgacacgggacaagcttacaaaccttctctgaacctcagttttctcatttacaagaggcaaagccatccatcaccttgtgtggattcagagaatgtgaggccctggggtgtcctacacaaggga

SEQ ID NO: 349022 - DNA, 872 bp, Homo sapiens
agcggggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtgagcctgagggactgccgcaacgtgtctgtgttcctggcccctagcgtgctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtg

SEQ ID NO: 349023 - DNA, 1033 bp, Homo sapiens
agcggggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgcggggcggggccaggccgggcaggggagctcggctgccgctcagggtctcaaggtctgggcgtggccggggtgagctccgccccgccgtgtggtagttcgggccgggctgcgggcggggcgggagcggccagtggactctcgccgccacccggtccaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtgagcctgagggactgccgcaacgtgtctgtgttcctggcccctagcgtgctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtg

SEQ ID NO: 349024 - DNA, 1046 bp, Homo sapiens
agcggggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtgagcctgagggactgccgcaacgtgtctgtgttcctggcccctagcgtggtaggtgcggggttgccagccccgctgggaagccccagccacaccccagggtgtttgctgctctgaggcctgggcctgcctggtgggtgctaggcttggggctaggggggtgagcgcggctgtttcttaccgggcccggccccggcccctctactctgctgttctctccctcagctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtg

SEQ ID NO: 349025 - DNA, 1175 bp, Homo sapiens
agcggggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgcggggcggggccaggccgggcaggggagctcggctgccgctcagggtctcaaggtctgggcgtggccggggtgagctccgccccgccgtgtggtagttcgggccgggctgcgggcggggcgggagcggccagtggactctcgccgccacccggtccaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtaacctggggatccctggccacccgctgacagcccaaggtgcggctgacacctgcgagggctgggggccgggactcggaagctgcgatgacccggtgcccaccaggcctctccccggccggggcgacttctcttccggcaggtgagcctgagggactgccgcaacgtgtctgtgttcctggcccctagcgtgctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtg

SEQ ID NO: 349026 - DNA, 795 bp, Homo sapiens
ccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgcggggcggggccaggccgggcaggggagctcggctgccgctcagggtctcaaggtctgggcgtggccggggtgagctccgccccgccgtgtggtagttcgggccgggctgcgggcggggcgggagcggccagtggactctcgccgccacccggtccaggtgccctacgtcggcgcgagcgcgcggcaggtggagcacgtgttgtcgctgctgcgaggacgccccggaaaaacggtggatctgggctctggcgacggcaggatcgtaagtgcctgcgtctgggtcttcgccgccccacaccgcccacctgctggcgggcgcccctgcccacatcctggttcccacactctcggtgcccacaggtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtaacctggggatccctggccac

SEQ ID NO: 349027 - DNA, 821 bp, Homo sapiens
agcggggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaagctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtg

SEQ ID NO: 349028 - DNA, 963 bp, Homo sapiens
agcggggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtaacctggggatccctggccacccgctgacagcccaaggtgcggctgacacctgcgagggctgggggccgggactcggaagctgcgatgacccggtgcccaccaggcctctccccggccggggcgacttctcttccggcagctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtg

SEQ ID NO: 349029 - DNA, 1188 bp, Homo sapiens
agcggggccacttccggtgtcgcgcggcggctcccggcaggaggcagagggcacaccgccagccccaggccaggctgcgagggccgcggacccgagccgggaaggaccttgggcggacgagccgcgcgtcccgcagccatggagcaggacgacccggtcgaggcgctgacggagctgcgcgagcggcggctgggcgcgctggagctgctgcaggcggcggccggctcgggcttggcagcctacgcggtgtgggcgctgctgctccagcccggcttccggcgcgtgccgctgcggctgcaggtgccctacgtcggcgcgagcgcgcggcaggtggagcacgtgttgtcgctgctgcgaggacgccccggaaaaacggtggatctgggctctggcgacggcaggatcgtgctggcggcccacaggtgcggcctccgcccggccgtgggctacgagctgaacccctggctggtggcgctggcgcggctgcacgcctggagggccggctgtgccggcagcgtctgctatcgccgcaaggatctctggaaggtaacctggggatccctggccacccgctgacagcccaaggtgcggctgacacctgcgagggctgggggccgggactcggaagctgcgatgacccggtgcccaccaggcctctccccggccggggcgacttctcttccggcaggtgagcctgagggactgccgcaacgtgtctgtgttcctggcccctagcgtggtaggtgcggggttgccagccccgctgggaagccccagccacaccccagggtgtttgctgctctgaggcctgggcctgcctggtgggtgctaggcttggggctaggggggtgagcgcggctgtttcttaccgggcccggccccggcccctctactctgctgttctctccctcagctcccgctgctggaggacaagctgcggacagagctgcctgctggggcccgcgtggtgtctgggcgcttcccactccccacctggcagcctgtgaccgcggttggcgagggcctggaccgagtatgggcttatgatgttcctgagggtgggcaggctggggaggccgcctcctcgcggatacccatccaggctgcccccggacctagttctgcccccatcccggggggccttatttctcaggccagctgagtattagacacgataaagactctgtg

SEQ ID NO: 349030 - DNA, 351 bp, Homo sapiens
atctactgatccctaattattctcatattttcctctctctatatatctatgagttcaaatttcaacagaaaaaaatttgaccatgtttggtctgttaccaacctatacagaatgcctatatggggcagaattctcacacctagccacatcataggtctttggctatcttacagctaatgacttgggaccagagacatggatatgggtatcatggtgacctgtaaagctggaactagtcctagttaccagctactttgtctaaaatacacagccaacactcaaaaagcaccacaatcttccagtaaaacaatcctaacttatatcactagaaataatgatttagaacattta

SEQ ID NO: 349031 - DNA, 645 bp, Homo sapiens
tatgaaagtggggctggtgaaggttgaattaactgctaaaccctccaccaagcaaagaggacacaaattgaaaacattgcctatgtgttttaatgggaacatggaataaataaatgaatatatatttacatatactcagagggagaggactatcttaaacaattcaaggtcatgaagagtatatgtgggaaaagaaaaggaagatgactgaggagtgtggattctaggatccagtcctgctgacacctccaccagctctgtctccttagacaagcttcctctttttgggccttggtgccttcatctgtaaagaggaaggagttggaatagttgatcttcagtgacactgtcagctttgtaatacccatgtgttcaaaccattcatcttatcttgggtaattattttttaaatattatttcaagatttaatttgtcaacttgtattcttcccctactgataactataaggtaatttaatgagttcgtaaattctgaaatggaattggtatcagtagaatgatgattatcatggattaaatattatattattctgcaaggaagatgtttctcccaagaaatcacactcctgtgtttatttaggtacttagtattttaagatcctcacttatttatcaaggtatttat

SEQ ID NO: 349032 - DNA, 790 bp, Homo sapiens
caaagtttgcttgaggagaacacattaagaatgccttagtaaattctgcccttgttttgaacttaggaaaattccacacaaatttatgtttttttctttaataaaataaatatgaagttaaattgcaggagaatgttatatttcagtttttttaaattccactttgaatgtctttttatgtagaagacacatctttgaaaacaatttatattaactttaacacttcataaaacaggagactgggaaaagagttcagttattcttaagaatataactctatgctcataaatttgcctgtttatgtggaatttgaactcttcaaaaaatggtaaatctttcagaagataacaagaattaaattaacacatctggccgtagctaaaggcacatataaattatctcattcatttgccaaaatttcaaaccaaagctaaaattttctttagaaagccaaaattagcaaacatttcttataatctttgtaactagttaatctgcaaattggcgtactcaatgtactttattatagagaagaagtaaaaatagtgctttaacaaaaatccctcttattgattttttttttttttaattttaaagagaccgtcttgctccattgcccaggctggagtacagtggtgcaattatagctcactgcaacctcaaactcctgggctcaagcaatcctcctgcctcggcctcctgagtagctgggactacagccatgcaccaccatgcacagctaatttttatttttactttttgtagagatggagtctcactatgttgtcca

SEQ ID NO: 349033 - DNA, 922 bp, Homo sapiens
  misc_feature (217)..(217): n is a, c, g, or t
  misc_feature (246)..(246): n is a, c, g, or t
  misc_feature (325)..(327): n is a, c, g, or t
  misc_feature (356)..(356): n is a, c, g, or t
  misc_feature (372)..(372): n is a, c, g, or t
  misc_feature (410)..(410): n is a, c, g, or t
  misc_feature (655)..(655): n is a, c, g, or t
  misc_feature (695)..(695): n is a, c, g, or t
  misc_feature (706)..(706): n is a, c, g, or t
  misc_feature (717)..(721): n is a, c, g, or t
  misc_feature (724)..(724): n is a, c, g, or t
  misc_feature (727)..(727): n is a, c, g, or t
  misc_feature (731)..(731): n is a, c, g, or t
  misc_feature (733)..(733): n is a, c, g, or t
  misc_feature (747)..(747): n is a, c, g, or t
tcaatcaccggcccggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgtcaatgaactgatggcgtgatgtctcacagaaagtnctcgcgttcgcagacatgggtccctcggncttcctgcctcggaagcgcaggcaggaggcagtcggtgggaaggtgaagagcgtgtccgctaaggatgacgccatccannncgcggtccacctcacagcttcctgggatnacaaggctgggatgantcacatcgtgcgggaagctcgacaggccgggatccaangtgaacaagacggaggtggtggaggctgtgacctgtggtagagagaacaaccatggtggtggtggggatggtggggtatgtgggaaaggaactcgattggccgtccggagctgtaggactgtctattaggtgagcacatcagtgatgaatgaagaggcgtttctataagaattggatagatctaagaagaaggctttaccgaggtactggagaaatggaggatgaggatggagaagcagtggggnaggattcaggagcatgaagaagtacgccagtcatccggtnatgccacaccngatgtgcgtcnnnnnggngcnaaananggccacctgatggngatcccggggacggaggcgggcgcggaaacgggagggccggggagttgagcagggggcccggacccaggtggcgggagagacgccgcccgggggccagggcaggcccacggggccacggggccaaaagggcgcaacaccgggcgcgggggtgggggacccggccggcgcgggaag

SEQ ID NO: 349034 - DNA, 387 bp, Homo sapiens
  misc_feature (9)..(9): n is a, c, g, or t
  misc_feature (219)..(219): n is a, c, g, or t
  misc_feature (238)..(238): n is a, c, g, or t
  misc_feature (245)..(245): n is a, c, g, or t
tggaaatanagtcagatggaaaattcattttttaaattcccgctttgtcactttttctgataaaagatggccatattacccctttcaggccacatgattctcagtaccccaggagctgggcttagtaaatagcaatgggttgcacgcctgaggcaattaggcactttggaagatggcataacctgtctcacctggacttaagcgtctggctgtaattcncagtgctcttttctcctcnctgtatncaggtccatggaggagaagaaagcattcatgggaccactgaagaaagaccgaattgcaaaggaagaaggagcttaatgccaggaacagattttgcagttggtggggtctcaataaaagttattttccactgaaaaaaaaaaa

SEQ ID NO: 349035 - DNA, 1201 bp, Homo sapiens
  misc_feature (165)..(165): n is a, c, g, or t
  misc_feature (337)..(337): n is a, c, g, or t
ccccctttgtaccctgccccttggtcacccgatgactcgatcaatctcacctgccctaacacttggttcacaggtacctgctgctcaagcctctcgcgggcccagtccagcttcttcggccacagtgcctcccgttcacctggatctccatcaggtgggccttcnttctggcgcagaggaagcaggcgcatctgggtgtgggcaatgacacggatgacttggcaggtacgttcttcatgctggctgaagtccttctccagctgcttcttgccatcctcatcctgccatttcttgcagtacttggtaaaggcccttcttctgtagattgtatgcccanttcttatagaaacgcctcttgcattcatcactgatgtgctcagcaaagacagtcttgaaaggtccggaggcctcgagggggtttccacgtagcccacaatgcccacaaccaccatgggtggtgtctctacaatggtcacagcctccaccacctccttcttgttcaccttggatcccggcctgtcgacttcccgcacgatgtgagtcatgccagccttgtatcccaggaaggctgtgaggtggaccggcttggacgggtcatccttagggaagctcttcaccttcccacgatgcctgctgctgcgcttccgaggcaggaagccgagggacccatgtctgggagcggagaactttctgtgagacatcacgccatcaaattctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagccacccagagggttgatgctcttgtgagataggtgatagtcagtggaggcattgttcttgatcagcttgccgtccttgataaggtagtcctggccaatcttaaaggaatatgatctatagcaaagattagcatgcagtaaggcctgcaggggctcccaggttttttatgactagatatatatagggcctttgctagactagattcaaat

SEQ ID NO: 349036 - DNA, 1235 bp, Homo sapiens
  misc_feature (165)..(165): n is a, c, g, or t
  misc_feature (370)..(370): n is a, c, g, or t
ccccctttgtaccctgccccttggtcacccgatgactcgatcaatctcacctgccctaacacttggttcacaggtacctgctgctcaagcctctcgcgggcccagtccagcttcttcggccacagtgcctcccgttcacctggatctccatcaggtgggccttcnttctggcgcagaggaagcaggcgcatctgggtgtgggcaatgacacggatgacttggcaggtacgttcttcatgctggctgaagtccttctccagctgcttcttgccatcccgcggtgttgttgggggcccaatcccccgtttgtcatcctgccatttcttgcagtacttggtaaaggcccttcttctgtagattgtatgcccanttcttatagaaacgcctcttgcattcatcactgatgtgctcagcaaagacagtcttgaaaggtccggaggcctcgagggggtttccacgtagcccacaatgcccacaaccaccatgggtggtgtctctacaatggtcacagcctccaccacctccttcttgttcaccttggatcccggcctgtcgacttcccgcacgatgtgagtcatgccagccttgtatcccaggaaggctgtgaggtggaccggcttggacgggtcatccttagggaagctcttcaccttcccacgatgcctgctgctgcgcttccgaggcaggaagccgagggacccatgtctgggagcggagaactttctgtgagacatcacgccatcaaattctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaaaaaaaaaaa

SEQ ID NO: 349037 - DNA, 543 bp, Homo sapiens
tcaatcaccggcccggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaaaaaaaaaaa

SEQ ID NO: 349038 - DNA, 257 bp, Homo sapiens
atgggttataaccatcccctccatgctgtccttgtgatagtgagtgggtgagttattgtgagttctggttgtttagaagtgtgagtcatgccagccttgtatcccaggaaggctgtgaggtggaccggcttggacgggtcatccttagggaagctcttcaccttcccacgatgcctgctgctgcgcttccgaggcaggaagccgagggacccatgtctgggagcggagaactttctgtgagacatcacgccatcaaa

SEQ ID NO: 349039 - DNA, 1202 bp, Homo sapiens
  misc_feature (165)..(165): n is a, c, g, or t
  misc_feature (337)..(337): n is a, c, g, or t
ccccctttgtaccctgccccttggtcacccgatgactcgatcaatctcacctgccctaacacttggttcacaggtacctgctgctcaagcctctcgcgggcccagtccagcttcttcggccacagtgcctcccgttcacctggatctccatcaggtgggccttcnttctggcgcagaggaagcaggcgcatctgggtgtgggcaatgacacggatgacttggcaggtacgttcttcatgctggctgaagtccttctccagctgcttcttgccatcctcatcctgccatttcttgcagtacttggtaaaggcccttcttctgtagattgtatgcccanttcttatagaaacgcctcttgcattcatcactgatgtgctcagcaaagacagtcttgaaaggtccggaggcctcgagggggtttccacgtagcccacaatgcccacaaccaccatgggtggtgtctctacaatggtcacagcctccaccacctccttcttgttcaccttggatcccggcctgtcgacttcccgcacgatgtgagtcatgccagccttgtatcccaggaaggctgtgaggtggaccggcttggacgggtcatccttagggaagctcttcaccttcccacgatgcctgctgctgcgcttccgaggcaggaagccgagggacccatgtctgggagcggagaactttctgtgagacatcacgccatcaaattctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaaaaaaaaaaa

SEQ ID NO: 349040 - DNA, 1015 bp, Homo sapiens
  misc_feature (165)..(165): n is a, c, g, or t
  misc_feature (337)..(337): n is a, c, g, or t
ccccctttgtaccctgccccttggtcacccgatgactcgatcaatctcacctgccctaacacttggttcacaggtacctgctgctcaagcctctcgcgggcccagtccagcttcttcggccacagtgcctcccgttcacctggatctccatcaggtgggccttcnttctggcgcagaggaagcaggcgcatctgggtgtgggcaatgacacggatgacttggcaggtacgttcttcatgctggctgaagtccttctccagctgcttcttgccatcctcatcctgccatttcttgcagtacttggtaaaggcccttcttctgtagattgtatgcccanttcttatagaaacgcctcttgcattcatcactgatgtgctcagcaaagacagtcttgaaaggtccggaggcctcgagggggtttccacgtagcccacaatgcccacaaccaccatgggtggtgtctctacaatggtcacagcctccaccacctccttcttgttcaccttggatcccggcctgtcgacttcccgcacgatgtgagtcatgccagccttgtatcccaggaaggctgtgaggtggaccggcttggacgggtcatccttagggaagctcttcaccttcccacgatgcctgctgctgcgcttccgaggcaggaagccgagggacccatgtctgggagcggagaactttctgtgagacatcacgccatcaaattctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgtaggtgtgggacttccaggtgcaggtgtgggactaccaggtgcaggtgtgggactacca

SEQ ID NO: 349041 - DNA, 552 bp, Homo sapiens
  misc_feature (30)..(30): n is a, c, g, or t
  misc_feature (44)..(44): n is a, c, g, or t
gatcccagacatgggtccctcggcttcctncctcggaagcgcanagcaggcatcgtgggaaggtgaagagcttccctaaggatgacccatccaagccggtccacctcacagccttcctgggatacaaggctggcatgactcacatcgtgcgggaagtcgacaggcctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaaaaaaaaaaa

SEQ ID NO: 349042 - DNA, 785 bp, Homo sapiens
tcagctacttagattgaccctaaaatgctaataaaactttctagactgtggtacttctcaacctttaggttacatttgaccatttgcatgtgtgtgtctcttttcttcctactagacccccttgagttagtgctttttttttttttttttttaaaatgtagatggagtctcactcttgttgcccgggctggagcgcagtggtgcaatctcggctcactgcaacctccacctcctgggttcaagtgattctcctgcctcagcctcccaaagtgctgggattacaggcatgaaccactgcgcctggcctaagttagtgcttttgatgtcacaaaaacttgggtgagtttgtttcagtagaattttctgaaaatacatgagatctttttactgtagtttctcagaagagaatactcaaagcatttgatactggatttgtagtgattttaattttcttctgtatcttttaatttttgattttaaaaatgggataagaagggcaaattactgattggtttaactagtttattcagagcttttcttaaaataatgacttgaaaggtggatttaatagagtactttttaaaaagattgttttctcatgcctgaaagcattgaatgtttttacatagctttatatctggatcagaagggaacgagttctaattcatgcttttttttccgttttattaatgactgaaagtcctcccccagaaattatcgtaacgtttattggtaattctctgtatcattctcgaaatgtttaatttccatttcctctttattta

SEQ ID NO: 349043 - DNA, 875 bp, Homo sapiens
gcccagcccttagttagacagaatctttactgctcttccaggttagggaggagggctctgtgtaagagaatggtggtggtggtaggggaatgggttggatggaaatcttccaggaggggccaggaatctgtgctgtgggggccctaccttctggcagttatgaatgaggcaggcactgggagctggagaggcagcagtctcttgctctgagggccctccggcagcgccttctttccctgaggtaggaggaccctcccctggtacttaattaattgcagtccctgttctgctctgttgttcagggtgagtggctggcctggttccaggcccacctgatctgcccacctcagcctcccaaagtgctgggattacaggcatgaaccactgcgcctggcctaagttagtgcttttgatgtcacaaaaacttgggtgagtttgtttcagtagaattttctgaaaatacatgagatctttttactgtagtttctcagaagagaatactcaaagcatttgatactggatttgtagtgattttaattttcttctgtatcttttaatttttgattttaaaaatgggataagaagggcaaattactgattggtttaactagtttattcagagcttttcttaaaataatgacttgaaaggtggatttaatagagtactttttaaaaagattgttttctcatgcctgaaagcattgaatgtttttacatagctttatatctggatcagaagggaacgagttctaattcatgcttttttttccgttttattaatgactgaaagtcctcccccagaaattatcgtaacgtttattggtaattctctgtatcattctcgaaatgtttaatttccatttcctctttattta

SEQ ID NO: 349044 - DNA, 415 bp, Homo sapiens
tcagctacttagattgaccctaaaatgctaataaaactttctagactgtggtacttctcaacctttaggttacatttgaccatttgcatgtgtgtgtctcttttcttcctactagacccccttgagttagtgctttttttttttttttttttaaaatgtagatggagtattgcgccactgcactccagcctgagtgacaaagtgagactccgtctcaaaaaaaaattttttttttgctttagtatacttatcagaagtataatgcagtacagagtgttgtacagtatttcagtgctgtacagagattaatcttgtggataataattgggagatactctatccctactctatttttaacagtttaatgtagttgagtgttcattagcaagtggttactttgaataatactggcaca

SEQ ID NO: 349045 - DNA, 260 bp, Homo sapiens
ataacttttcttaagctcgtttacagctcctggctcatctcttgcatttattctcataaaaactaaaggaataaacatacatataaatgcattcacacagactcccatgatgcatcgtttatctgtcagtatttctttctgaaatatatcatttgtgggtaaagaatgtagaatttaaattatcatattgttttaaggttcttatgtgacatataaatgtagtaatgtccaaagactagaaaacccatgagtgtgataaa

SEQ ID NO: 349046 - DNA, 255 bp, Homo sapiens
tttgatgatatttattgcttgatctgtttaggtatagggttgacttgttctaagcttatttttgtctcaaaggggaagaaggaaatagaatcaacaatgcatttcaattttagattaaaagtcactggaaatgaaaccgaaatacacaaaatatatgtatactcacacagtgtgcttctataatgaattcttttcatatacagatttattactagtcttattatttgatagccatcttttccattatatgaattc

SEQ ID NO: 349047 - DNA, 731 bp, Homo sapiens
gagaggtggggcgggcgtcaccaccggagtggagggcgaggcccgggtcccgcgctcccctgggcgccccacggcagcctcagagccccgcggggagcgcgcagccctcggggcgggcgccggggtgaggcctggctcggtccctgcgcaccgggtgcgggcggcggagagggcgcggctggtgagccctgggagggcccaggagccagacctcggttttgcgggctggggagcagggctcgggggcagcggccaggcccctccgcccctaacacccgcgcctcctgcagacccgagggtcgccgctggtagggtcgctcagccctggcgtcctccaccaccacaccttcacctgcataccctacggaggaagccctggagccaagtggatcgagggatgccctgctcagcacccagcccgcctggcctccacccagctatgagagcatcagccttgctcttgatgccgtttctgcagagacgacaccgagtgccacacgctcctgctcaggcctggttcagactgcacggggaggaagttaaaggctcctagcaggtcctgaatccagagacaaaaatgctgtgccttctccagagtcttatgcagtgcctgggacacagtaggcactcagcaaacgttcgttgttgaaggctgttctatttatctattgctgtataacaaaccaccccagaatttagtggcttaaaataaatcccattttattatgact

SEQ ID NO: 349048 - DNA, 1223 bp, Homo sapiens
gagaggtggggcgggcgtcaccaccggagtggagggcgaggcccgggtcccgcgctcccctgggcgccccacggcagcctcagagccccgcggggagcgcgcagccctcggggcgggcgccggggtgaggcctggctcggtccctgcgcaccgggtgcgggcggcggagagggcgcggctggtgagccctgggagggcccaggagccagacctcggttttgcgggctggggagcagggctcgggggcagcggccaggcccctccgcccctaacacccgcgcctcctgcagacccgagggtcgccgctggtagggtcgctcagccctggcgtcctccaccaccacaccttcacctgcgcccagctccctgcgcgcctggacagcgcctgctgcccgcctcccgatggccctgccccagatgtgtgacgggagccacttggcctccaccctccgctattgcatgacagtcagcggcacagtggttctggtggccgggacgctctgcttcgcttggtggagcgaaggggatgcaaccgcccagcctggccagctggccccacccacggagtatccggtgcctgagggccccagccccctgctcaggtccgtcagcttcgtctgctgcggtgcaggtggcctgctgctgctcattggcctgctgtggtccgtcaaggccagcatcccagggccacctcgatgggacccctatcacctctccagagacctgtactacctcactgtggagtcctcagagaaggagagctgcaggacccccaaagtggttgacatccccacttacgaggaagccgtgagcttcccagtggccgaggggcccccaacaccacctgcataccctacggaggaagccctggagccaagtggatcgagggatgccctgctcagcacccagcccgcctggcctccacccagctatgagagcatcagccttgctcttgatgccgtttctgcagagacgacaccgagtgccacacgctcctgctcaggcctggttcagactgcacggggaggaagttaaaggctcctagcaggtcctgaatccagagacaaaaatgctgtgccttctccagagtcttatgcagtgcctgggacacagtaggcactcagcaaacgttcgttgttgaaggctgttctatttatctattgctgtataacaaaccaccccagaatttagtggcttaaaataaatcccattttattatgact

SEQ ID NO: 349049 - DNA, 314 bp, Homo sapiens
tcagcccctggactctcagtcactgccctagggtaggacttaccctgcagagagaactgaggaggcaccaggaggtgctgggagcacatacagggaactaattctatggcgcagggagtgggtggcgggaaggctgagggccacaggggctggctcatgccaagtttcaactgcgtatatgtgaccctggagagccacaaaggcttggagcagggtgtgaagacttctctgcccccagccttcctcactgtctctctggcaggcagcagggtctgccccagcccctgctaacagcctctcttctgttcctgcag

SEQ ID NO: 349050 - DNA, 553 bp, Homo sapiens
  misc_feature (13)..(13): n is a, c, g, or t
  misc_feature (84)..(84): n is a, c, g, or t
tttacttaaacgncagccaagtggtttcttgacaccaacaagtcttggaaacttaaagcttgcagtgacttcttctttaattanccacccgttacaggacccccaaagtggttgacatccccacttacgaggaagccgtgagcttcccagtggccgaggggcccccaacaccacctgcataccctacggaggaagccctggagccaagtggatcgagggatgccctgctcagcacccagcccgcctggcctccacccagctatgagagcatcagccttgctcttgatgccgtttctgcagagacgacaccgagtgccacacgctcctgctcaggcctggttcagactgcacggggaggaagttaaaggctcctagcaggtcctgaatccagagacaaaaatgctgtgccttctccagagtcttatgcagtgcctgggacacagtaggcactcagcaaacgttcgttgttgaaggctgttctatttatctattgctgtataacaaaccaccccagaatttagtggcttaaaataaatcccattttattatgact

SEQ ID NO: 349051 - DNA, 250 bp, Homo sapiens
atagaaaagaaaatgggggaggggatgatagaaccgaaagtactaggagatggagagattgtcaccatgcagagaaccccacctggcttccttctcctgtctcccaacctccccaagccttgatgtgccttttgtttgggatggtgtgagatcagggaccacagatcacactcttctggctttttttacttattgctgttgaagattagaccttaagggaaatgaattttttttttttccgagacagtct

SEQ ID NO: 349052 - DNA, 666 bp, Homo sapiens
gggctcttgtaacagtgaaagaagataatgtatgtaacacctgccacacaaaaggtactattattatgtgagctgctccacctgcttcttgaagactactggttctaactttagtgcaacattataaatatttctaatcctgtcctactctgttttctgttgcttataacagaatacctgaaatgggtaattctaaagaaaaggaatttatgtcttacagttatggaggttaagaagtccatggtcgaggggctacatctgctaagagcctccttgctggtggggactctccaagaatcccaggacaacagagagcatcacagggcaagggggctgagtgtgctcatgtgctcactcaagtctctcttccttttcttacaaagccaccagtcccactcccatgataaccccttaatccattaattcatgaatggatcaatcacttcttaaaggcctcacctctcaacactctcacattgaggatgaaatttcaacatgagttttggagaggacaaatatgtaaactatagtacatcacaatatcaataacacaaaatgtataccaaaagagaggtacatttgacttttgaaaagccaggtttgaactacatgggtccacttatacacagatttttttcaataaatatatttggaaaaatttttgga
